United States Patent 7,745,391 (HUMAN THROMBOSPONDIN POLYPEPTIDE) - sequence listing, part 127

SEQ ID NO: 354621 - DNA, 1637 bp, Homo sapiens
agcgggctggagcgtgcgcacaggcggcagcagtggccgtcactgggcggcatggcggtgtgtgctcgcctttgcggcgtgggcccgtcgcgcggatgtcggcgccgccagcagcgccggggcccggccgagacggcggcggccgacagcgagccggacacagaccccgaggaggagcgcatcgaggctagcgccggggtcgggggcggcttgtgcgcgggcccctcgccgccgcccccgcgctgctcgctgctggagctgccgcccgagctgctggtggagatcttcgcgtcgctgccgggcacggacctacccagcttggcccaggtctgcacgaagttccggcgcatcctccacaccgacaccatctggaggaggcgttgccgtgaggagtatggtgtttgcgaaaacttgcggaagctggagatcacaggcgtgtcttgtcgggacgtctatgcgaagctgcttcaccgatatagacacattttgggattgtggcagccagatatcgggccatacggaggactgctgaacgtggtggtggacggcctgttcatcatcgggtggatgtacctgcctccccatgacccccacgtcgatgaccctatgagattcaagcctctgttcaggatccacctgatggagaggaaggctgccacagtggagtgcatgtacggccacaaagggccccaccacggccacatccagattgtgaagaaggatgagttctccaccaagtgcaaccagacggaccaccacaggatgtccggcgggaggcaggaggagtttcggacgtggctgagggaggaatgggggcgcacgctggaggacatcttccacgagcacatgcaggagctcatcctgatgaagttcatctacaccagtcagtacgacaactgcctgacctaccgccgcatctacctgccgcccagccgccccgacgacctcatcaagcctggcctcttcaaaggtacctatggcagccacggcctggagattgtgatgctcagcttccacggccggcgtgccaggggcaccaagatcacgggcgaccccaacatccccgctgggcagcagacagtggagatcgacctgaggcatcggatccagctgcccgacctcgagaaccagcgcaacttcaatgagctctcccgcatcgtcctggaggtgcgcgagagggtgcgccaggagcagcaggaaggcgggcacgaggcgggcgagggtcgtggccggcagggcccccgggagtcccagccaagccctgcccagcccagggcagaggcgcccagcaagggcccagatgggacacctggtgaggatggtggcgagcctggggatgccgtagctgcggccgagcagcctgcccagtgtgggcaggggcagccgttcgtgctgcccgtgggcgtgagctccaggaatgaggactacccccgaacctgcaggatgtggtaaggatgcggcgggtactggggcctgaaggtgggacagcatgggcttcagcgagggccccagccccacacctagcacaggcggagagggcctgtgacctcacagagggcggcagccggtgctttgggacaggagtgcggcctctgaccccttgggccatgttccccagcacctgagcaagcggccgc

SEQ ID NO: 354622 - DNA, 3622 bp, Homo sapiens
agcgggctggagcgtgcgcacaggcggcagcagtggccgtcactgggcggcatggcggtgtgtgctcgcctttgcggcgtgggcccgtcgcgcggatgtcggcgccgccagcagcgccggggcccggccgagacggcggcggccgacagcgagccggacacagaccccgaggaggagcgcatcgaggctagcgccggggtcgggggcggcttgtgcgcgggcccctcgccgccgcccccgcgctgctcgctgctggagctgccgcccgagctgctggtggagatcttcgcgtcgctgccgggcacggacctacccagcttggcccaggtctgcacgaagttccggcgcatcctccacaccgacaccatctggaggaggcgttgccgtgaggagtatggtgtttgcgaaaacttgcggaagctggagatcacaggcgtgtcttgtcgggacgtctatgcgaagctgcttcaccgatatagacacattttgggattgtggcagccagatatcgggccatacggaggactgctgaacgtggtggtggacggcctgttcatcatcgggtggatgtacctgcctccccatgacccccacgtcgatgaccctatgagattcaagcctctgttcaggatccacctgatggagaggaaggctgccacagtggagtgcatgtacggccacaaagggccccaccacggccacatccagattgtgaagaaggatgagttctccaccaagtgcaaccagacggaccaccacaggatgtccggcgggaggcaggaggagtttcggacgtggctgagggaggaatgggggcgcacgctggaggacatcttccacgagcacatgcaggagctcatcctgatgaagttcatctacaccagtcagtacgacaactgcctgacctaccgccgcatctacctgccgcccagccgccccgacgacctcatcaagcctggcctcttcaaaggtacctatggcagccacggcctggagattgtgatgctcagcttccacggccggcgtgccaggggcaccaagatcacgggcgaccccaacatccccgctgggcagcagacagtggagatcgacctgaggcatcggatccagctgcccgacctcgagaaccagcgcaacttcaatgagctctcccgcatcgtcctggaggtgcgcgagagggtgcgccaggagcagcaggaaggcgggcacgaggcgggcgagggtcgtggccggcagggcccccgggagtcccagccaagccctgcccagcccagggcagaggcgcccagcaagggcccagatgggacacctggtgaggatggtggcgagcctggggatgccgtagctgcggccgagcagcctgcccagtgtgggcaggggcagccgttcgtgctgcccgtgggcgtgagctccaggaatgaggactacccccgaacctgcaggatgtgtttttatggcacaggcctcatcgcgggccacggcttcaccagccctgaacgcacccccggggtcttcatcctcttcgatgaggaccgcttcgggttcgtctggctggagctgaaatccttcagcctgtacagccgggtccaggccaccttccggaacgcagatgcgccgtccccacaggccttcgatgagatgctcaagaacattcagtccctcacctcctgaccggccacatccttgccgccacatcccgggtggctctggggctctgaactctgacctgtgaatagaagcagcatgcactttggaaatccggccttttgaccagaacgcacacctcgtcggggggcccagtccagccaccccccagcactttatgtagagagtgtgacatagacctgcatatttgtcagtgccatgatggaagaagctgagcatgtcttaccaaaaacagagagaacgagcctgaatacagcagatgtaggggacagccgtgggaccgcgtgagaattgaagcggtggggttcccgcaccctgggctggctggtggttttctcgggaagcaggaccctcctgactggtgctcttcctgtgagcggatagagtgatagactgggtcgtgtgtgagacgcatgtgctccaccccactccttttgggggaagccaggcaacagtggcctctgggagggggtcaggaagaggcgaacagctcaggcagcgcaggtgtgatgggcacagtacgcagagcaagctcgggaagttggtaggatctcaggcttggggccgggactctggagtgaatccccatttctctaccggcttgcttggagtttggacagaagcatttcacctctgatctcagcttccccacctgtggagtgggtttagtgacctgagtcactagggaatgtcacctgaatgcacagcccagcccatgcacctgccccagcccctccagctttggagccaaggccatcgttccagccacttgactgtcctcgacggcctgttccagacagggcgtttgttttgtccatgccttcctccctgcacgcacacggcgtcaaaaccaagctgccggccactgtctccagaacgcaaggctccaggcccgtgtgtctgaagcagtgagtggtccacacaggtgccaggagtgcccatatgagatgacgaggaaacccctttgcaggtgaggggacagctttctagaaaagccacacctgcatctggggacacactttggaaagtgggaccctccagcctggagaccccatggactgatgcctccactgctgtgtgccccatgttgtgttaacacctgcgtgtggggaccccatctgaggtcttggctgaggttggcatctcctgaagaacagagagcacggtgtccagagctggcccttcccccagcccacagccagctccgtgcccgagtgggcgtccccagcgagccttccctctctgccgcttgtccttgtgtctgggctgctccaagtccttgtgctgggcaccctggacacgtcctgctggtgagggacctcgggaaggtgacagtctgtgtgccttggtgtggagaccaacctgaggatgtcctgggaaatgttttcctgatgaatttctccttgactggcctttaaagaacataagaattcccattgcccagcctcagtgcatttggcaaatgcttactttgcttcccagagtcagagaattggcaaaggttcctaaatggtaatctggccggcctgggagaaagactcacgagaaaagccagtggagaaagcgcccttccagggcggcagcagcgggagccacgcagaccccgaggcgcacctgctggctcttgtgtgtggccccagtttctagcggcttttgcagcattagcctacaagctttgtcactccctgccctctgtggtggtcactgtttttctctcttgccaaatgaggcagtctctgagtgacggtgactgtggccttgaagcctggaggactgttgggcatgtagactggcaccttgaagattcaccattgtttaaataaaatcaagcaaatgcttttttaccaagagcccgagcctcgctctaagggacgcagtcctagaggcgtgccctttggggcttgaagagcacactgtgggacgcacgtgcttctgattaaaggaatctcagatctca

SEQ ID NO: 354623 - DNA, 1822 bp, Homo sapiens
gaagatttagaggcggcctggtttgtaattcatgacgtgccgggttatgttcatactgggccgggtcgacattgtacaactggagtggggctgcctgcagtgcagctctgcacacctgaacgtgttctttgtcacttgtttggaaatgatgtgattgaagatttcagagaggtcattggaggcttttctgtgccggcactgaatgttcatttgcatgaggaagttgcaaacgacttctgcaggctgagattcaaggcaggtggtattggggtccctcagcccacctgggccgtgacctcaagtgtccactgctgagtgtgagtggctttgcaggcctggtggtgggagagcctcaggctccctccttcttcgttcctgaccatgccctgggccccttcagtctgcctgcggctctgtggcatccctgccctgacactgggcacctgtgcccctagcaagcccacctggcacacgaggagggaggggtgggtggccatgtccttcctctagccacatgccctgctggccgctccattctgagctttgtgcagaaccgggtctgagctggagatttttctctgagaacctgcagttgtgcttgcagccgcacgcaagggcccttcagccgctggctctggcttccctgactcctcagggcgtgttcacccccaggctttctcacctgcacacggttaggccattttcagtgctcgtgggcagtcacggacagcagcagaaactcctcagcccctttgttacttcagaacgcctgcccacatgcatcttctgagctcgtgttgtcctcatggccgtggggtcttgggtgcgaacaggagatgctgagctgtggtccaccgtccaaggtgctgcagaaagcagctaggctcttttaggatgtttctattctggttgctgccttcgtggtgtaacttttaagaacacttacgggaatgtgctcatagaaccatcacctgtcctgagaataaaactcctggaatcatgatcaagtccagtgttaacgtggcccaacctgtctgtacttctggggagagaccaggaacatcactggactcctcatccccgtaattatttagagaagatgcaagcagcagatagtctccatgcggctggtactttttttgttgttttttgagacagggtcttgctctgtcacctgggctggagtgcagagcggcgatcatggctccctgaggcctcaacctactaggctcaagctgtctgcccgccttagcctcccaagtagctgggaccacaggcacccaccaccaccatgcttggctaacttgtttttgtagagatggagttttgccatgttgctcaggttggtctcgaactcccgatctcaggtgatccacccgcctcggcctcccaaagtgctgggattacaggcgtgagcccctgcgccccagccttggggcctgtctttgaatgggaatgagactgtgcaaaccgtggactaccctgtgtcacccacagctcagtggcctgcctgccggccctcaggggctgctgaccgggagaccagccagagcacgagggggtcagggctgtgtgggttttggcctgattctgcatttggttgtttctgggggccatgtagcctgcctgcattaggaaagcgctgtgccatctgatcatgagcccctctgcaccccctggtaaggtgaccttgcagcaggagctgtgccctgcctgggtaggcacccactaggtaggaccggagcaatcctggcagccgccacctgcacccgtgcacttgtttctcctcacagtttcaagtaaatccgtttttgaaggctag

SEQ ID NO: 354624 - DNA, 3404 bp, Homo sapiens
cgcatgctcccggtcgtgccccagccccgcccagcaccgctgggcgcctgaggcccctgagattccgaaatttttaacctctgaagctgtgccttcacatgatctaggacagcgttcagaagatggctacagtctgttggtttgtattctgtgaaaatagaaaaaaaaatccgagtatggtgtttgcgaaaacttgcggaagctggagatcacaggcgtgtcttgtcgggacgtctatgcgaagctgcttcaccgatatagacacattttgggattgtggcagccagatatcgggccatacggaggactgctgaacgtggtggtggacggcctgttcatcatcgggtggatgtacctgcctccccatgacccccacgtcgatgaccctatgagattcaagcctctgttcaggatccacctgatggagaggaaggctgccacagtggagtgcatgtacggccacaaagggccccaccacggccacatccagattgtgaagaaggatgagttctccaccaagtgcaaccagacggaccaccacaggatgtccggcgggaggcaggaggagtttcggacgtggctgagggaggaatgggggcgcacgctggaggacatcttccacgagcacatgcaggagctcatcctgatgaagttcatctacaccagtcagtacgacaactgcctgacctaccgccgcatctacctgccgcccagccgccccgacgacctcatcaagcctggcctcttcaaaggtacctatggcagccacggcctggagattgtgatgctcagcttccacggccggcgtgccaggggcaccaagatcacgggcgaccccaacatccccgctgggcagcagacagtggagatcgacctgaggcatcggatccagctgcccgacctcgagaaccagcgcaacttcaatgagctctcccgcatcgtcctggaggtgcgcgagagggtgcgccaggagcagcaggaaggcgggcacgaggcgggcgagggtcgtggccggcagggcccccgggagtcccagccaagccctgcccagcccagggcagaggcgcccagcaagggcccagatgggacacctggtgaggatggtggcgagcctggggatgccgtagctgcggccgagcagcctgcccagtgtgggcaggggcagccgttcgtgctgcccgtgggcgtgagctccaggaatgaggactacccccgaacctgcaggatgtgtttttatggcacaggcctcatcgcgggccacggcttcaccagccctgaacgcacccccggggtcttcatcctcttcgatgaggaccgcttcgggttcgtctggctggagctgaaatccttcagcctgtacagccgggtccaggccaccttccggaacgcagatgcgccgtccccacaggccttcgatgagatgctcaagaacattcagtccctcacctcctgaccggccacatccttgccgccacatcccgggtggctctggggctctgaactctgacctgtgaatagaagcagcatgcactttggaaatccggccttttgaccagaacgcacacctcgtcggggggcccagtccagccaccccccagcactttatgtagagagtgtgacatagacctgcatatttgtcagtgccatgatggaagaagctgagcatgtcttaccaaaaacagagagaacgagcctgaatacagcagatgtaggggacagccgtgggaccgcgtgagaattgaagcggtggggttcccgcaccctgggctggctggtggttttctcgggaagcaggaccctcctgactggtgctcttcctgtgagcggatagagtgatagactgggtcgtgtgtgagacgcatgtgctccaccccactccttttgggggaagccaggcaacagtggcctctgggagggggtcaggaagaggcgaacagctcaggcagcgcaggtgtgatgggcacagtacgcagagcaagctcgggaagttggtaggatctcaggcttggggccgggactctggagtgaatccccatttctctaccggcttgcttggagtttggacagaagcatttcacctctgatctcagcttccccacctgtggagtgggtttagtgacctgagtcactagggaatgtcacctgaatgcacagcccagcccatgcacctgccccagcccctccagctttggagccaaggccatcgttccagccacttgactgtcctcgacggcctgttccagacagggcgtttgttttgtccatgccttcctccctgcacgcacacggcgtcaaaaccaagctgccggccactgtctccagaacgcaaggctccaggcccgtgtgtctgaagcagtgagtggtccacacaggtgccaggagtgcccatatgagatgacgaggaaacccctttgcaggtgaggggacagctttctagaaaagccacacctgcatctggggacacactttggaaagtgggaccctccagcctggagaccccatggactgatgcctccactgctgtgtgccccatgttgtgttaacacctgcgtgtggggaccccatctgaggtcttggctgaggttggcatctcctgaagaacagagagcacggtgtccagagctggcccttcccccagcccacagccagctccgtgcccgagtgggcgtccccagcgagccttccctctctgccgcttgtccttgtgtctgggctgctccaagtccttgtgctgggcaccctggacacgtcctgctggtgagggacctcgggaaggtgacagtctgtgtgccttggtgtggagaccaacctgaggatgtcctgggaaatgttttcctgatgaatttctccttgactggcctttaaagaacataagaattcccattgcccagcctcagtgcatttggcaaatgcttactttgcttcccagagtcagagaattggcaaaggttcctaaatggtaatctggccggcctgggagaaagactcacgagaaaagccagtggagaaagcgcccttccagggcggcagcagcgggagccacgcagaccccgaggcgcacctgctggctcttgtgtgtggccccagtttctagcggcttttgcagcattagcctacaagctttgtcactccctgccctctgtggtggtcactgtttttctctcttgccaaatgaggcagtctctgagtgacggtgactgtggccttgaagcctggaggactgttgggcatgtagactggcaccttgaagattcaccattgtttaaataaaatcaagcaaatgcttttttaccaagagcccgagcctcgctctaagggacgcagtcctagaggcgtgccctttggggcttgaagagcacactgtgggacgcacgtgcttctgattaaaggaatctcagatctca

SEQ ID NO: 354625 - DNA, 5100 bp, Homo sapiens
agcgggctggagcgtgcgcacaggcggcagcagtggccgtcactgggcggcatggcggtgtgtgctcgcctttgcggcgtgggcccgtcgcgcggatgtcggcgccgccagcagcgccggggcccggccgagacggcggcggccgacagcgagccggacacagaccccgaggaggagcgcatcgaggctagcgccggggtcgggggcggcttgtgcgcgggcccctcgccgccgcccccgcgctgctcgctgctggagctgccgcccgagctgctggtggagatcttcgcgtcgctgccgggcacggacctacccagcttggcccaggtctgcacgaagttccggcgcatcctccacaccgacaccatctggaggaggcgttgccgtgaggagtatggtgtttgcgaaaacttgcggaagctggagatcacaggcgtgtcttgtcgggacgtctatgcgaagctgcttcaccgatatagacacattttgggattgtggcagccagatatcgggccatacggaggactgctgaacgtggtggtggacggcctgttcatcatcgggtggatgtacctgcctccccatgacccccacgtcgatgaccctatgagattcaagcctctgttcaggatccacctgatggagaggaaggctgccacagtggagtgcatgtacggccacaaagggccccaccacggccacatccagattgtgaagaaggatgagttctccaccaagtgcaaccagacggaccaccacaggatgtccggcgggaggcaggaggagtttcggacgtggctgagggaggaatgggggcgcacgctggaggacatcttccacgagcacatgcaggagctcatcctgatgaagttcatctacaccagtcagtacgacaactgcctgacctaccgccgcatctacctgccgcccagccgccccgacgacctcatcaagcctggcctcttcaaaggtacctatggcagccacggcctggagattgtgatgctcagcttccacggccggcgtgccaggggcaccaagatcacgggcgaccccaacatccccgctgggcagcagacagtggagatcgacctgaggcatcggatccagctgcccgacctcgagaaccagcgcaacttcaatgagctctcccgcatcgtcctggaggtgcgcgagagggtgcgccaggagcagcaggaaggcgggcacgaggcgggcgagggtcgtggccggcagggcccccgggagtcccagccaagccctgcccagcccagggcagaggcgcccagcaagggcccagatgggacacctggtgaggatggtggcgagcctggggatgccgtagctgcggccgagcagcctgcccagtgtgggcaggggcagccgttcgtgctgcccgtgggcgtgagctccaggaatgaggactacccccgaacctgcaggatgtgtttttatggcacaggcctcatcgcgggccacggcttcaccagccctgaacgcacccccggggtcttcatcctcttcgatgaggaccgcttcgggttcgtctggctggagctgaaatccttcagcctgtacagccgggtccaggccaccttccggaacgcagatgcgccgtccccacaggccttcgatgagatgctcaagaacattcagtccctcacctcctgaccggccacatccttgccgccacatcccgggtggctctggggctctgaactctgacctgtgaatagaagcagcatgcactttggaaatccggccttttgaccagaacgcacacctcgtcggggggcccagtccagccaccccccagcactttatgtagagagtgtgacatagacctgcatatttgtcagtgccatgatggaagaagctgagcatgtcttaccaaaaacagagagaacgagcctgaatacagcagatgtaggggacagccgtgggaccgcgtgagaattgaagcggtggggttcccgcaccctgggctggctggtggttttctcgggaagcaggaccctcctgactggtgctcttcctgtgagcggatagagtgatagactgggtcgtgtgtgagacgcatgtgctccaccccactccttttgggggaagccaggcaacagtggcctctgggagggggtcaggaagaggcgaacagctcaggcagcgcaggtgtgatgggcacagtacgcagagcaagctcgggaagttggtaggatctcaggcttggggccgggactctggagtgaatccccatttctctaccggcttgcttggagtttggacagaagcatttcacctctgatctcagcttccccacctgtggagtgggtttagtgacctgagtcactagggaatgtcacctgaatgcacagcccagcccatgcacctgccccagcccctccagctttggagccaaggccatcgttccagccacttgactgtcctcgacggcctgttccagacagggcgtttgttttgtccatgccttcctccctgcacgcacacggcgtcaaaaccaagctgccggccactgtctccagaacgcaaggctccaggcccgtgtgtctgaagcagtgagtggtccaccttgaagattcaccattgtttaaataaaatcaagcaaatgcttttttaccaagagcccgagcctcgctctaagggacgcagtcctagaggcgtgccctttggggcttgaagagcacactgtgggacgcacgtgcttctgattaaaggaatctcagatctcaattacgcttccagtgtttgggtatagaaatagcttccacccatcatgtctcagccatgggctgttggtcagttcatgtggctcctggttctggtgtgtatgttgggggcgggggtctctccatggtggtgacctgcagtgatgccaggcagggccagagccacacagccaggaaagggaggcctttttggccgcacagccagtcccttcagtcgtgactacaggtcttgttttttccgctccgatgtgtccttagccagttcttggctccggttctgtagggacaggcactgaatctgcgcgcctcaaaacagcagcttcccttccgggggagggcatccaccctctcaggggatcctgcaggtggcccatttcctgcaggtgagaactcggaagggctgatgtcgtcatcagaggcctaagggcagctgagagttggataaaaccgtttccaaggaggaggctgagtaacccagttcaggacagccaagcgcattaggcttgattggggaaggtggcaggtggagttgggaggttgggactctccatcttttgcaccacggatgcctttctgtcgctgtctcactctggggcaggatcaagtctgctctctggagtggggctgcctgcagtgcagctctgcacacctgaacgtgttctttgtcacttgtttggaaatgatgtgattgaagatttcagagaggtcattggaggcttttctgtgccggcactgaatgttcatttgcatgaggaagttgcaaacgacttctgcaggctgagattcaaggcaggtggtattggggtccctcagcccacctgggccgtgacctcaagtgtccactgctgagtgtgagtggctttgcaggcctggtggtgggagagcctcaggctccctccttcttcgttcctgaccatgccctgggccccttcagtctgcctgcggctctgtggcatccctgccctgacactgggcacctgtgcccctagcaagcccacctggcacacgaggagggaggggtgggtggccatgtccttcctctagccacatgccctgctggccgctccattctgagctttgtgcagaaccgggtctgagctggagatttttctctgagaacctgcagttgtgcttgcagccgcacgcaagggcccttcagccgctggctctggcttccctgactcctcagggcgtgttcacccccaggctttctcacctgcacacggttaggccattttcagtgctcgtgggcagtcacggacagcagcagaaactcctcagcccctttgttacttcagaacgcctgcccacatgcatcttctgagctcgtgttgtcctcatggccgtggggtcttgggtgcgaacaggagatgctgagctgtggtccaccgtccaaggtgctgcagaaagcagctaggctcttttaggatgtttctattctggttgctgccttcgtggtgtaacttttaagaacacttacgggaatgtgctcatagaaccatcacctgtcctgagaataaaactcctggaatcatgatcaagtccagtgttaacgtggcccaacctgtctgtacttctggggagagaccaggaacatcactggactcctcatccccgtaattatttagagaagatgcaagcagcagatagtctccatgcggctggtactttttttgttgttttttgagacagggtcttgctctgtcacctgggctggagtgcagagcggcgatcatggctccctgaggcctcaacctactaggctcaagctgtctgcccgccttagcctcccaagtagctgggaccacaggcacccaccaccaccatgcttggctaacttgtttttgtagagatggagttttgccatgttgctcaggttggtctcgaactcccgatctcaggtgatccacccgcctcggcctcccaaagtgctgggattacaggcgtgagcccctgcgccccagccttggggcctgtctttgaatgggaatgagactgtgcaaaccgtggactaccctgtgtcacccacagctcagtggcctgcctgccggccctcaggggctgctgaccgggagaccagccagagcacgagggggtcagggctgtgtgggttttggcctgattctgcatttggttgtttctgggggccatgtagcctgcctgcattaggaaagcgctgtgccatctgatcatgagcccctctgcaccccctggtaaggtgaccttgcagcaggagctgtgccctgcctgggtaggcacccactaggtaggaccggagcaatcctggcagccgccacctgcacccgtgcacttgtttctcctcacagtttcaagtaaatccgtttttgaaggctag

SEQ ID NO: 354626 - DNA, 583 bp, Homo sapiens
agagacggacagcggcggagaggcagacagcggcagcgcggcggagaggcggccagcggcggagaggcggacagcggcggagaggcggacagcggcggcgcggcggagagacggacagcggcggagaggcagacagcggcggcgaggcgcgcagcggcggcgcaggcgcggagaggcgctggcgccggctctggcgcggagaggcgcaggcccaggctccactccccagctgtgaaagggttttctgcctcctgctaagccaatttatacattccaagaaaatcttccatttcatccaggtgaaacagaacctactggaatgaagctggcctcccatggaatgaagctggcctcccgtctccttgatttgaagcagcttctgcacgttggttattatgccatttttctaaatctaacattttaaaatttgtgccttttctttctcttttgcttgacttctcagaggtttttttaacggtcttttcaaagaagtggttttgggttttatttatcaagtctacttttattatggctgttttaaaattaaatacatttatttcttgtttcccttaaaaaaaaaaat

SEQ ID NO: 354627 - DNA, 376 bp, Homo sapiens
ctgcatggattttggcatatccaggatggctagatgggatacttggtatgattctgacagcaactaattttgcttaacaatgttcatgatattcttaaaacaaaaatatgctgcatcaaatatctacattttaattattctggatctacttaattcatgctagtagaatgtgtatagagcagttattttcgttgatagaaaatgtttcaccacattaaggggtaaaaggagtagaatttgaacctaattacttacgtttagttgactgactaaatgtttatttcttgtcagtgcagtttccaacaacctcatttgatggtggggggtgacctgggcacactgtggaaggctggcagctgatcgccaggctggggtg

SEQ ID NO: 354628 - DNA, 379 bp, Homo sapiens
  misc_feature (10)..(10): n is a, c, g, or t
  misc_feature (14)..(14): n is a, c, g, or t
ggcacgaccncgtncgaattcggcacgagatccactccacctgttatactagtgttcttgtgggaattttatcagttatatttggggaaagcacatccagttttccgtttggacattgttaataaatctgaggtgggtttttcccatactcctcatgctaactttgtggtatacttttggttttaaaaaatgtatcttagtgttttttttgttaaaatagctttcttttattagggaacttttgagaagttaaaaattctgcttctgaattgtatttgaatagtatgggcttacaacaaaaaccagataattcttgcttctattctttttgaatatttttcccctctaataaagtacttgattcgaatacacttccttt

SEQ ID NO: 354629 - DNA, 1052 bp, Homo sapiens
tgtggccgccgaggagtcccttgctgaaggcggaccgcggagcggcgggcggcgggcggcgcgcgcgcgcgcgcgagaggcggctgttggagaagtggagcggcggtcgcggggggaggaggaggagggactgagcggcggcggcccccgcgtcccgtgcctctatgggggaagcagacaatggattatgatttcaaggcgaagctggcggcggagcgggagcgggtggaggatttgtttgagtacgaagggtgcaaagtgggacgcggcacctacggtcacgtctacaaggcgaggcggaaagatggattccaggagggcttcgtgtatggacctcaagcgttggaggtagcagacttttcagcagaaggtaaagatgcaaattgggtgcttcacagagacttgaaaccagcaaatatcctagtaatgggagaaggtcctgagagggggagagtcaaaataggtaggtaattattcctaaaataatttatttaaaaactgaagttaactgcaaagatggtttccctttttaatgcccttatttaggtagttaattttaaaattactttctcattatttttagaaaagatattggaaaatgtagatagatagtctacaaaactcctaggttttttcccaaaataagattctttagttctaagttgaggcatcactggaaattgacaagctagttcacaaaagcattcattcccatacagtaacccaagcatgtgtttatgtcaccaccactgtcctgcacagccaccttaaatataatcctctaaatctcacttctgtttcaggtttaccaactattctcttcctgaatattttcctccccaccctgagcgaatatatttaaaccttcacaggttctccctacttcaccacacctggcctgcatgtcttgcaccaagtactaacataccttttccaaatagatatatatgtttacagactctcttagctgcctctcttagattgaggcactggcaggattcttatttgtatattaagatttcctttataatcctgaatgttctaaaaaaaaa

SEQ ID NO: 354630 - DNA, 6074 bp, Homo sapiens
agcgggaggggcggccctggtacgcaggcgcgcatgctttgtgggggcgaggctgtggtggcccgagattccaggagggcttcgtgtatggacctcaagcgttggaggtagcagacttttcagcagaaggtaaagaaaagatgaaaaggaatatgcattgaagcaaattgaaggcacaggaatatccatgtcggcttgtagagagattgcacttttgcgagaattgaagcaccctaatgtgattgcattgcagaaggtgttcctttctcacagtgacaggaaggtatggctgctgtttgattatgcagagcatgacttgtggcatattattaagtttcaccgtgcatcaaaagcaaataaaaagcccatgcagttgccaagatctatggttaaatccttactttaccagattcttgatggtatccattacctccatgcaaattgggtgcttcacagagacttgaaaccagcaaatatcctagtaatgggagaaggtcctgagagggggagagtcaaaatagctgacatgggttttgccagattattcaattctcctctaaagccactagcagatttggatccagtagttgtgacattttggtatcgggctccagaacttttgcttggtgcaaggcattatacaaaggccattgatatatgggcaataggttgtatatttgctgaattgttgacttcggaacctatttttcactgtcgtcaggaagatataaaaacaagcaatccctttcatcatgatcaactggatcggatatttagtgtcatggggtttcctgcagataaagactgggaagatattagaaagatgccagaatatcccacacttcaaaaagactttagaagaacaacgtatgccaacagtagcctcataaagtacatggagaaacacaaggtcaagcctgacagcaaagtgttcctcttgcttcagaaactcctgaccatggatccaaccaagagaattacctcggagcaagctctgcaggatccctattttcaggaggaccctttgccaacattagatgtatttgccggctgccagattccataccccaaacgagaattccttaatgaagatgatcctgaagaaaaaggtgacaagaatcagcaacagcagcagaaccagcatcagcagcccacagcccctccacagcaggcagcagcccctccacaggcgcccccaccacagcagaacagcacccagaccaacgggaccgcaggtggggctggggccggggtcgggggcaccggagcagggttgcagcacagccaggactccagcctgaaccaggtgcctccaaacaagaagccacggctagggccttcaggcgcaaactcaggtggacctgtgatgccctcggattatcagcactccagttctcgcctgaattaccaaagcagcgttcagggatcctctcagtcccagagcacacttggctactcttcctcgtctcagcagagctcacagtaccacccatctcaccaggcccaccggtactgaccagctcccgttgggccaggccagcccagcccagagcacaggctccagcaatatgtctgcattgaaaagaaccaaaaaaatgcaaactatgatgccatttaaaactcatacacatgggaggaaaaccttatatactgagcattgtgcaggactgatagctcttctttattgacttaaagaagattcttgtgaagtttccccagcaccccttccctgcatgtgttccattgtgacttctctgataaagcgtctgatctaatcccagcacttctgtaaccttcagcatttctttgaaggatttcctggtgcacctttctcatgctgtagcaatcactatggtttatcttttcaaagctcttttaataggattttaatgttttagaaacaggattccagtggtgtatagttttatacttcatgaactgatttagcaacacaggtaaaaatgcaccttttaaagcactacgttttcacagacaataactgttctgctcatggaagtcttaaacagaaactgttactgtcccaaagtactttactattacgttcgtatttatctagtttcagggaaggtctaataaaaagacaagcggtgggacagagggaacctacaaccaaaaactgcctagatctttgcagttatgtgctttatgccacgaagaactgaagtatgtggtaatttttatagaatcattcatatggaactgagttcccagcatcatcttattctgaatagcattcagtaattaagaattacaattttaaccttcatgtagctaagtctaccttaaaaagggtttcaagagctttgtacagtctcgatggcccacaccaaaacgctgaagagagtaacaactgcactaggatttctgtaaggagtaattttgatcaaaagacgtgttacttccctttgaaggaaaagtttttagtgtgtattgtacataaagtcggcttctctaaagaaccattggtttcttcacatctgggtctgcgtgagtaactttcttgcataatcaaggttactcaagtagaagcctgaaaattaatctgcttttaaaataaagagcagtgttctccattcgtatttgtattagatatagagtgactatttttaaagcatgttaaaaatttaggttttattcatgtttaaagtatgtattatgtatgcataattttgctgttgttactgaaacttaattctatcaagaatctttttcattgcactgaatgatttcttttgcccctaggagaaaacttaataattgtgcctaaaaactatgggcggatagtataagactatactagacaaagtgaatatttgcatttccattatctatgaattagtggctgagttctttcttagctgctttaaggagcccctcactccccagagtcaaaaggaaatgtaaaaacttagagctcccattgtaatgtaaggggcaagaaatttgtgttcttctgaatgctactagcagcaccagccttgttttaaatgttttcttgagctagaagaaatagctgattattgtatatgcaaattacatgcatttttaaaaactattctttctgaacttatctacctggttatgatactgtgggtccatacacaagtaaaataagattagacagaagccagtatacattttgcactattgatgtgatactgtagccagccaggaccttactgatctcagcataataatgctcactaataatgaagtctgcatagtgacactcatcaagactgaagatgaagcaggttacgtgctccattggaaggagtttctgatagtctcctgctgttttaccccttccattttttaaaataagaaattagcagccctctgcataatgtagctgcctatatgcagttttatcctgtgccctaaagcctcactgtccagagctgttggtcatcagatgcttattgcaccctcaccatgtgcctggtgccctgctgggtagagaacacagaggacagggcatacttcttgtccttaaggagcttgtgatctgtgacagtaagccctcctgggatgtctgtgccatgtgattgacttacaagtgaaactgtcttataatatgaaggtctttttgtttacttctaaacccacttgggtagttactatccccaaatctgttctgtaaataatattatggaagggtttctatgtcagtctaccttagagaaagccagtgattcaatatcacaaaaggcattgacgtatctttgaaatgttcacagcagccttttaacaacaactgggtggtccttgtaggcagaacatactctcctaagtggttgtaggaaattgcaaggaaaatagaaggtctgttcttgctctcaaggaggttacctttaataaaagaagacaaacccagatagatatgtaaaccaaaatactatgccccttaatactttataagcagcattgttaaatagttcttacgcttatacattcacagaactaccctgttttccttgtatataatgacttttgctggcagaactgaaatataaactgtaaggggatttcgtcagttgctcccagtatacaatatcctccaggacatagccagaaatctccattccacacatgactgagttcctatccctgcactggtactggctcttttctcctctttccttgcctcagggttcgtgctacccactgattccctttacccttagtaataattttggatcattttctttcctttaaaggggaacaaagccttttttttttttgagacggagtgttgctctgtcacccaagctggagtgcagtggcacgaatcttggctcactccaacctccaccttccaggttcaagtgattctcctgcctcagcctcccgagtagctgggactacgggcacgcaccaccacgtctggctaatttttgtatttttagtagagatggggtttcaccctattggtcaggctggtcttgaattcctcacctcaggtcatccgcctgtctcggcctcccgaagtgctgggattataggtgtgagccaccgcacccagttgggaacaaagcctttttaacacacgtaagggccctcaaaccgtgggacctctaaggagacctttgaagctttttgagggcaaactttacctttgtggtccccaaatgatggcatttctctttgaaatttattagatactgttatgtcccccaagggtacaggaggggcatccctcagcctatgggaacacccaaactaggaggggttattgacaggaaggaatgaatccaagtgaaggctttctgctcttcgtgttacaaaccagtttcagagttagctttctggggaggtgtgtgtttgtgaaaggaattcaagtgttgcaggacagatgagctcaaggtaaggtagctttggcagcagggctgatactatgaggctgaaacaatccttgtgatgaagtagatcatgcagtgacatacaaagaccaaggattatgtatatttttatatctctgtggttttgaaactttagtacttagaattttggccttctgcactactcttttgctcttacgaacataatggactcttaagaatggaaagggatgacatttacctatgtgtgctgcctcattcctggtgaagcaactgctacttgttctctatgcctctaaaatgatgctgttttctctgctaaaggtaaaagaaaagaaaaaaatagttggaaaataagacatgcaacttgatgtgcttttgagtaaatttatgcagcagaaactatacaatgaaggaagaattctatggaaattacaaatccaaaactctatgatgatgtcttcctagggagtagagaaaggcagtgaaatggcagttagaccaacagaggcttgaaggattcaagtacaagtaatattttgtataaaacatagcagtttaggtccccataatcctcaaaaatagtcacaaatataacaaagttcattgttttagggtttttaaaaaacgtgttgtacctaaggccatacttactcttctatgctatcactgcaaaggggtgatatgtatgtattatataaaaaaaaaaacccttaatgcactgttatctcctaaatatttagtaaattaatactatttaatttttttaaagatttgtctgtgtagacactaaaagtattacacaaaatctggactgaaggtgtcctttttaacaacaatttaaagtactttttatatatgttatgtagtatatcctttctaaactgcctagtttgtatattcctataattcctatttgtgaagtgtacctgttcttgtctcttttttcagtcattttctgcacgcatccccctttatatggttatagagatgactgtagcttttcgtgctccactgcgaggtttgtgctcagagccgctgcaccccagcgaggcctgctccatggagtgcaggacgagctactgctttggagcgagggtttcctgcttttgagttgacctgacttccttcttgaaatgactgttaaaactaaaataaattacattgcatttattttatattcttggttgaaataaaatttaattgactttg

SEQ ID NO: 354631 - DNA, 5368 bp, Homo sapiens
tgtggccgccgaggagtcccttgctgaaggcggaccgcggagcggcgggcggcgggcggcgcgcgcgcgcgcgcgagaggcggctgttggagaagtggagcggcggtcgcggggggaggaggaggagggactgagcggcggcggcccccgcgtcccgtgcctctatgggggaagcagacaatggattatgatttcaaggcgaagctggcggcggagcgggagcgggtggaggatttgtttgagtacgaagggtgcaaagtgggacgcggcacctacggtcacgtctacaaggcgaggcggaaagatggaaaagatgaaaaggaatatgcattgaagcaaattgaaggcacaggaatatccatgtcggcttgtagagagattgcacttttgcgagaattgaagcaccctaatgtgattgcattgcagaaggtgttcctttctcacagtgacaggaaggtatggctgctgtttgattatgcagagcatgacttgtggcatattattaagtttcaccgtgcatcaaaagcaaataaaaagcccatgcagttgccaagatctatggttaaatccttactttaccagattcttgatggtatccattacctccatgcaaattgggtgcttcacagagacttgaaaccagcaaatatcctagtaatgggagaaggtcctgagagggggagagtcaaaatagctgacatgggttttgccagattattcaattctcctctaaagccactagcagatttggatccagtagttgtgacattttggtatcgggctccagaacttttgcttggtgcaaggcattatacaaaggccattgatatatgggcaataggttgtatatttgctgaattgttgacttcggaacctatttttcactgtcgtcaggaagatataaaaacaagcaatccctttcatcatgatcaactggatcggatatttagtgtcatggggtttcctgcagataaagactgggaagatattagaaagatgccagaatatcccacacttcaaaaagactttagaagaacaacgtatgccaacagtagcctcataaagtacatggagaaacacaaggtcaagcctgacagcaaagtgttcctcttgcttcagaaactcctgaccatggatccaaccaagagaattacctcggagcaagctctgcaggatccctattttcaggaggaccctttgccaacattagatgtatttgccggctgccagattccataccccaaacgagaattccttaatgaagatgatcctgaagaaaaaggtgacaagaatcagcaacagcagcagaaccagcatcagcagcccacagcccctccacagcaggcagcagcccctccacaggcgcccccaccacagcagaacagcacccagaccaacgggaccgcaggtggggctggggccggggtcgggggcaccggagcagggttgcagcacagccaggactccagcctgaaccaggtgcctccaaacaagaagccacggctagggccttcaggcgcaaactcaggtggacctgtgatgccctcggattatcagcactccagttctcgcctgaattaccaaagcagcgttcagggatcctctcagtcccagagcacacttggctactcttcctcgtctcagcagagctcacagtaccacccatctcaccaggcccaccggtactgaccagctcccgttgggccaggccagcccagcccagagcacaggctccagcaatatgtctgcattgaaaagaaccaaaaaaatgcaaactatgatgccatttaaaactcatacacatgggaggaaaaccttatatactgagcattgtgcaggactgatagctcttctttattgacttaaagaagattcttgtgaagtttccccagcaccccttccctgcatgtgttccattgtgacttctctgataaagcgtctgatctaatcccagcacttctgtaaccttcagcatttctttgaaggatttcctggtgcacctttctcatgctgtagcaatcactatggtttatcttttcaaagctcttttaataggattttaatgttttagaaacaggattccagtggtgtatagttttatacttcatgaactgatttagcaacacaggtaaaaatgcaccttttaaagcactacgttttcacagacaataactgttctgctcatggaagtcttaaacagaaactgttactgtcccaaagtactttactattacgttcgtatttatctagtttcagggaaggtctaataaaaagacaagcggtgggacagagggaacctacaaccaaaaactgcctagatctttgcagttatgtgctttatgccacgaagaactgaagtatgtggtaatttttatagaatcattcatatggaactgagttcccagcatcatcttattctgaatagcattcagtaattaagaattacaattttaaccttcatgtagctaagtctaccttaaaaagggtttcaagagctttgtacagtctcgatggcccacaccaaaacgctgaagagagtaacaactgcactaggatttctgtaaggagtaattttgatcaaaagacgtgttacttccctttgaaggaaaagtttttagtgtgtattgtacataaagtcggcttctctaaagaaccattggtttcttcacatctgggtctgcgtgagtaactttcttgcataatcaaggttactcaagtagaagcctgaaaattaatctgcttttaaaataaagagcagtgttctccattcgtatttgtattagatatagagtgactatttttaaagcatgttaaaaatttaggttttattcatgtttaaagtatgtattatgtatgcataattttgctgttgttactgaaacttaattctatcaagaatctttttcattgcactgaatgatttcttttgcccctaggagaaaacttaataattgtgcctaaaaactatgggcggatagtataagactatactagacaaagtgaatatttgcatttccattatctatgaattagtggctgagttctttcttagctgctttaaggagcccctcactccccagagtcaaaaggaaatgtaaaaacttagagctcccattgtaatgtaaggggcaagaaatttgtgttcttctgaatgctactagcagcaccagccttgttttaaatgttttcttgagctagaagaaatagctgattattgtatatgcaaattacatgcatttttaaaaactattctttctgaacttatctacctggttatgatactgtgggtccatacacaagtaaaataagattagacagaagccagtatacattttgcactattgatgtgatactgtagccagccaggaccttactgatctcagcataataatgctcactaataatgaagtctgcatagtgacactcatcaagactgaagatgaagcaggttacgtgctccattggaaggagtttctgatagtctcctgctgttttaccccttccattttttaaaataagaaattagcagccctctgcataatgtagctgcctatatgcagttttatcctgtgccctaaagcctcactgtccagagctgttggtcatcagatgcttattgcaccctcaccatgtgcctggtgccctgctgggtagagaacacagaggacagggcatacttcttgtccttaaggagcttgtgatctgtgacagtaagccctcctgggatgtctgtgccatgtgattgacttacaagtgaaactgtcttataatatgaaggtctttttgtttacttctaaacccacttgggtagttactatccccaaatctgttctgtaaataatattatggaagggtttctatgtcagtctaccttagagaaagccagtgattcaatatcacaaaaggcattgacgtatctttgaaatgttcacagcagccttttaacaacaactgggtggtccttgtaggcagaacatactctcctaagtggttgtaggaaattgcaaggaaaatagaaggtctgttcttgctctcaaggaggttacctttaataaaagaagacaaacccagatagatatgtaaaccaaaatactatgccccttaatactttataagcagcattgttaaatagttcttacgcttatacattcacagaactaccctgttttccttgtatataatgacttttgctggcagaactgaaatataaactgtaaggggatttcgtcagttgctcccagtatacaatatcctccaggacatagccagaaatctccattccacacatgactgagttcctatccctgcactggtactggctcttttctcctctttccttgcctcagggttcgtgctacccactgattccctttacccttagtaataattttggatcattttctttcctttaaaggggaacaaagccttttttttttttgagacggagtgttgctctgtcacccaagctggagtgcagtggcacgaatcttggctcactccaacctccaccttccaggttcaagtgattctcctgcctcagcctcccgagtagctgggactacgggcacgcaccaccacgtctggctaatttttgtatttttagtagagatggggtttcaccctattggtcaggctggtcttgaattcctcacctcaggtcatccgcctgtctcggcctcccgaagtgctgggattataggtgtgagccaccgcacccagttgggaacaaagcctttttaacacacgtaagggccctcaaaccgtgggacctctaaggagacctttgaagctttttgagggcaaactttacctttgtggtccccaaatgatggcatttctctttgaaatttattagatactgttatgtcccccaagggtacaggaggggcatccctcagcctatgggaacacccaaactaggaggggttattgacaggaaggaatgaatccaagtgaaggctttctgctcttcgtgttacaaaccagtttcagagttagctttctggggaggtgtgtgtttgtgaaaggaattcaagtgttgcaggacagatgagctcaaggtaaggtagctttggcagcagggctgatactatgaggctgaaacaatccttgtgatgaagtagatcatgcagtgacatacaaagaccaaggattatgtatatttttatatctctgtggttttgaaactttagtacttagaattttggccttctgcactactcttttgctcctaactccattcagccctccctcttttggcccagttcctcccaccccctcagtcccatttcctagcagaatcagaagattgtgaagaggccggcttcatcaaaatgggataaaaaaataattttttaggacttaaaaa

SEQ ID NO: 354632 - DNA, 2869 bp, Homo sapiens
tgtggccgccgaggagtcccttgctgaaggcggaccgcggagcggcgggcggcgggcggcgcgcgcgcgcgcgcgagaggcggctgttggagaagtggagcggcggtcgcggggggaggaggaggagggactgagcggcggcggcccccgcgtcccgtgcctctatgggggaagcagacaatggattatgatttcaaggcgaagctggcggcggagcgggagcgggtggaggatttgtttgagtacgaagggtgcaaagtgggacgcggcacctacggtcacgtctacaaggcgaggcggaaagatggaaaagatgaaaaggaatatgcattgaagcaaattgaaggcacaggaatatccatgtcggcttgtagagagattgcacttttgcgagaattgaagcaccctaatgtgattgcattgcagaaggtgttcctttctcacagtgacaggaaggtatggctgctgtttgattatgcagagcatgacttgtggcatattattaagtttcaccgtgcatcaaaagcaaataaaaagcccatgcagttgccaagatctatggttaaatccttactttaccagattcttgatggtatccattacctccatgcaaattgggtgcttcacagagacttgaaaccagcaaatatcctagtaatgggagaaggtcctgagagggggagagtcaaaatagctgacatgggttttgccagattattcaattctcctctaaagccactagcagatttggatccagtagttgtgacattttggtatcgggctccagaacttttgcttggtgcaaggcattatacaaaggccattgatatatgggcaataggttgtatatttgctgaattgttgacttcggaacctatttttcactgtcgtcaggaagatataaaaacaagcaatccctttcatcatgatcaactggatcggatatttagtgtcatggggtttcctgcagataaagactgggaagatattagaaagatgccagaatatcccacacttcaaaaagactttagaagaacaacgtatgccaacagtagcctcataaagtacatggagaaacacaaggtcaagcctgacagcaaagtgttcctcttgcttcagaaactcctgaccatggatccaaccaagagaattacctcggagcaagctctgcaggatccctattttcaggaggaccctttgccaacattagatgtatttgccggctgccagattccataccccaaacgagaattccttaatgaagatgatcctgaagaaaaaggtgacaagaatcagcaacagcagcagaaccagcatcagcagcccacagcccctccacagcaggcagcagcccctccacaggcgcccccaccacagcagaacagcacccagaccaacgggaccgcaggtggggctggggccggggtcgggggcaccggagcagggttgcagcacagccaggactccagcctgaaccaggtgcctccaaacaagaagccacggctagggccttcaggcgcaaactcaggtggacctgtgatgccctcggattatcagcactccagttctcgcctgaattaccaaagcagcgttcagggatcctctcagtcccagagcacacttggctactcttcctcgtctcagcagagctcacagtaccacccatctcaccaggcccaccggtactgaccagctcccgttgggccaggccagcccagcccagagcacaggctccagcaatatgtctgcattgaaaagaaccaaaaaaatgcaaactatgatgccatttaaaactcatacacatgggaggaaaaccttatatactgagcattgtgcaggactgatagctcttctttattgacttaaagaagattcttgtgaagtttccccagcaccccttccctgcatgtgttccattgtgacttctctgataaagcgtctgatctaatcccagcacttctgtaaccttcagcatttctttgaaggatttcctggtgcacctttctcatgctgtagcaatcactatggtttatcttttcaaagctcttttaataggattttaatgttttagaaacaggattccagtggtgtatagttttatacttcatgaactgatttagcaacacaggtaaaaatgcaccttttaaagcactacgttttcacagacaataactgttctgctcatggaagtcttaaacagaaactgttactgtcccaaagtactttactattacgttcgtatttatctagtttcagggaaggtctaataaaaagacaagcggtgggacagagggaacctacaaccaaaaactgcctagatctttgcagttatgtgctttatgccacgaagaactgaagtatgtggtaatttttatagaatcattcatatggaactgagttcccagcatcatcttattctgaatagcattcagtaattaagaattacaattttaaccttcatgtagctaagtctaccttaaaaagggtttcaagagctttgtacagtctcgatggcccacaccaaaacgctgaagagagtaacaactgcactaggatttctgtaaggagtaattttgatcaaaagacgtgttacttccctttgaaggaaaagtttttagtgtgtattgtacataaagtcggcttctctaaagaaccattggtttcttcacatctgggtctgcgtgagtaactttcttgcataatcaaggttactcaagtagaagcctgaaaattaatctgcttttaaaataaagagcagtgttctccattcgtatttgtattagatatagagtgacgacttggtttagcacattcaaagatctttgtttttactcagtggcctatgtaacacatgtatgcatgcactgcc

SEQ ID NO: 354633 - DNA, 1125 bp, Homo sapiens
aggacgtcattctccagcccccgccaatgagcagcgggacggggggcggggcaataggcggacccactgccctagaaaagaaacaagctgcggtacaactgtcctcaccagccctcgcctcccgagtcactgcagccaacccttcagcaaggagttgagggagaactgtaggaacaccttgggaagcctttactggttgtcctcttaagaagagctggataatgtactgagaatacctgtcctttcttggtcctggagggcagacagcagctacagcaggactggtggaaccagcttcctggcaggaattaccctcccccaaagctagggacccaggaagatgccctgtccagcatagactttaaagagagtcaaactctacggaagaggattgtaacggaccatttctgaataaagtgatgatcagccacaatgacattagtaaaatttgaagtgccgcttatctttgtgcgtgctgttataatttgatgtggttggtatatgaactctaggactaaagtacgttgtgtgcgtatgcactaacttcataaaacaactctattataaagtgttttgtcataaggtatcgtgaaaattgcaaagtgctatccaagtgtaaaggattattattattgcagaattttttttttcttttgtaactgaacaggccttaaggtactcagttgtttctcataattcctttaattaccaggtgtccttgaatgcttatcatggaatgtgagatactataattaacatattttggttttggaatatccactccacctgttatactagtgttcttgtgggaattttatcagttatatttggggaaagcacatccagttttccgtttggacattgttaataaatctgaggtgggtttttcccatactcctcatgctaactttgtggtatacttttggttttaaaaaatgtatcttagtgttttttttgttaaaatagctttcttttattagggaacttttgagaagttaaaaattctgcttctgaattgtatttgaatagtatgggcttacaacaaaaaccagataattcttgcttctattctttttgaatatttttcccctctaataaagtacttgattcgaatacacttccttt

SEQ ID NO: 354634 - DNA, 242 bp, Homo sapiens
cattataacccctcattaacatggtcacagtcaccctcaaaatagattgttttggttgaacttattactcaaattatttttctttgtgtcattattggcctttaataagtaattttaaaatatagagcatttgttacagcattgattgtgttttattggcatagatattagcaaagactatattattatgtttttttttaatttttagcatattattaagtttcaccgtgcatcaaaagcaa

SEQ ID NO: 354635 - DNA, 1282 bp, Homo sapiens
tgtggccgccgaggagtcccttgctgaaggcggaccgcggagcggcgggcggcgggcggcgcgcgcgcgcgcgcgagaggcggctgttggagaagtggagcggcggtcgcggggggaggaggaggagggactgagcggcggcggcccccgcgtcccgtgcctctatgggggaagcagacaatggattatgatttcaaggcgaagctggcggcggagcgggagcgggtggaggatttgtttgagtacgaagggtgcaaagtgggacgcggcacctacggtcacgtctacaaggcgaggcggaaagatgggagttgagggagaactgtaggaacaccttgggaagcctttactggttgtcctcttaagaagagctggataatgtactgagaatacctgtcctttcttggtcctggagggcagacagcagctacagcaggactggtggaaccagcttcctggcaggaattaccctcccccaaagctagggacccaggaagatgccctgtccagcatagactttaaagagagtcaaactctacggaagaggattgtaacggaccatttctgaataaagtgatgatcagccacaatgacattagtaaaatttgaagtgccgcttatctttgtgcgtgctgttataatttgatgtggttggtatatgaactctaggactaaagtacgttgtgtgcgtatgcactaacttcataaaacaactctattataaagtgttttgtcataaggtatcgtgaaaattgcaaagtgctatccaagtgtaaaggattattattattgcagaattttttttttcttttgtaactgaacaggccttaaggtactcagttgtttctcataattcctttaattaccaggtgtccttgaatgcttatcatggaatgtgagatactataattaacatattttggttttggaatatccactccacctgttatactagtgttcttgtgggaattttatcagttatatttggggaaagcacatccagttttccgtttggacattgttaataaatctgaggtgggtttttcccatactcctcatgctaactttgtggtatacttttggttttaaaaaatgtatcttagtgttttttttgttaaaatagctttcttttattagggaacttttgagaagttaaaaattctgcttctgaattgtatttgaatagtatgggcttacaacaaaaaccagataattcttgcttctattctttttgaatatttttcccctctaataaagtacttgattcgaatacacttccttt

SEQ ID NO: 354636 - DNA, 6247 bp, Homo sapiens
tgtggccgccgaggagtcccttgctgaaggcggaccgcggagcggcgggcggcgggcggcgcgcgcgcgcgcgcgagaggcggctgttggagaagtggagcggcggtcgcggggggaggaggaggagggactgagcggcggcggcccccgcgtcccgtgcctctatgggggaagcagacaatggattatgatttcaaggcgaagctggcggcggagcgggagcgggtggaggatttgtttgagtacgaagggtgcaaagtgggacgcggcacctacggtcacgtctacaaggcgaggcggaaagatggaaaagatgaaaaggaatatgcattgaagcaaattgaaggcacaggaatatccatgtcggcttgtagagagattgcacttttgcgagaattgaagcaccctaatgtgattgcattgcagaaggtgttcctttctcacagtgacaggaaggtatggctgctgtttgattatgcagagcatgacttgtggcatattattaagtttcaccgtgcatcaaaagcaaataaaaagcccatgcagttgccaagatctatggttaaatccttactttaccagattcttgatggtatccattacctccatgcaaattgggtgcttcacagagacttgaaaccagcaaatatcctagtaatgggagaaggtcctgagagggggagagtcaaaatagctgacatgggttttgccagattattcaattctcctctaaagccactagcagatttggatccagtagttgtgacattttggtatcgggctccagaacttttgcttggtgcaaggcattatacaaaggccattgatatatgggcaataggttgtatatttgctgaattgttgacttcggaacctatttttcactgtcgtcaggaagatataaaaacaagcaatccctttcatcatgatcaactggatcggatatttagtgtcatggggtttcctgcagataaagactgggaagatattagaaagatgccagaatatcccacacttcaaaaagactttagaagaacaacgtatgccaacagtagcctcataaagtacatggagaaacacaaggtcaagcctgacagcaaagtgttcctcttgcttcagaaactcctgaccatggatccaaccaagagaattacctcggagcaagctctgcaggatccctattttcaggaggaccctttgccaacattagatgtatttgccggctgccagattccataccccaaacgagaattccttaatgaagatgatcctgaagaaaaaggtgacaagaatcagcaacagcagcagaaccagcatcagcagcccacagcccctccacagcaggcagcagcccctccacaggcgcccccaccacagcagaacagcacccagaccaacgggaccgcaggtggggctggggccggggtcgggggcaccggagcagggttgcagcacagccaggactccagcctgaaccaggtgcctccaaacaagaagccacggctagggccttcaggcgcaaactcaggtggacctgtgatgccctcggattatcagcactccagttctcgcctgaattaccaaagcagcgttcagggatcctctcagtcccagagcacacttggctactcttcctcgtctcagcagagctcacagtaccacccatctcaccaggcccaccggtactgaccagctcccgttgggccaggccagcccagcccagagcacaggctccagcaatatgtctgcattgaaaagaaccaaaaaaatgcaaactatgatgccatttaaaactcatacacatgggaggaaaaccttatatactgagcattgtgcaggactgatagctcttctttattgacttaaagaagattcttgtgaagtttccccagcaccccttccctgcatgtgttccattgtgacttctctgataaagcgtctgatctaatcccagcacttctgtaaccttcagcatttctttgaaggatttcctggtgcacctttctcatgctgtagcaatcactatggtttatcttttcaaagctcttttaataggattttaatgttttagaaacaggattccagtggtgtatagttttatacttcatgaactgatttagcaacacaggtaaaaatgcaccttttaaagcactacgttttcacagacaataactgttctgctcatggaagtcttaaacagaaactgttactgtcccaaagtactttactattacgttcgtatttatctagtttcagggaaggtctaataaaaagacaagcggtgggacagagggaacctacaaccaaaaactgcctagatctttgcagttatgtgctttatgccacgaagaactgaagtatgtggtaatttttatagaatcattcatatggaactgagttcccagcatcatcttattctgaatagcattcagtaattaagaattacaattttaaccttcatgtagctaagtctaccttaaaaagggtttcaagagctttgtacagtctcgatggcccacaccaaaacgctgaagagagtaacaactgcactaggatttctgtaaggagtaattttgatcaaaagacgtgttacttccctttgaaggaaaagtttttagtgtgtattgtacataaagtcggcttctctaaagaaccattggtttcttcacatctgggtctgcgtgagtaactttcttgcataatcaaggttactcaagtagaagcctgaaaattaatctgcttttaaaataaagagcagtgttctccattcgtatttgtattagatatagagtgactatttttaaagcatgttaaaaatttaggttttattcatgtttaaagtatgtattatgtatgcataattttgctgttgttactgaaacttaattctatcaagaatctttttcattgcactgaatgatttcttttgcccctaggagaaaacttaataattgtgcctaaaaactatgggcggatagtataagactatactagacaaagtgaatatttgcatttccattatctatgaattagtggctgagttctttcttagctgctttaaggagcccctcactccccagagtcaaaaggaaatgtaaaaacttagagctcccattgtaatgtaaggggcaagaaatttgtgttcttctgaatgctactagcagcaccagccttgttttaaatgttttcttgagctagaagaaatagctgattattgtatatgcaaattacatgcatttttaaaaactattctttctgaacttatctacctggttatgatactgtgggtccatacacaagtaaaataagattagacagaagccagtatacattttgcactattgatgtgatactgtagccagccaggaccttactgatctcagcataataatgctcactaataatgaagtctgcatagtgacactcatcaagactgaagatgaagcaggttacgtgctccattggaaggagtttctgatagtctcctgctgttttaccccttccattttttaaaataagaaattagcagccctctgcataatgtagctgcctatatgcagttttatcctgtgccctaaagcctcactgtccagagctgttggtcatcagatgcttattgcaccctcaccatgtgcctggtgccctgctgggtagagaacacagaggacagggcatacttcttgtccttaaggagcttgtgatctgtgacagtaagccctcctgggatgtctgtgccatgtgattgacttacaagtgaaactgtcttataatatgaaggtctttttgtttacttctaaacccacttgggtagttactatccccaaatctgttctgtaaataatattatggaagggtttctatgtcagtctaccttagagaaagccagtgattcaatatcacaaaaggcattgacgtatctttgaaatgttcacagcagccttttaacaacaactgggtggtccttgtaggcagaacatactctcctaagtggttgtaggaaattgcaaggaaaatagaaggtctgttcttgctctcaaggaggttacctttaataaaagaagacaaacccagatagatatgtaaaccaaaatactatgccccttaatactttataagcagcattgttaaatagttcttacgcttatacattcacagaactaccctgttttccttgtatataatgacttttgctggcagaactgaaatataaactgtaaggggatttcgtcagttgctcccagtatacaatatcctccaggacatagccagaaatctccattccacacatgactgagttcctatccctgcactggtactggctcttttctcctctttccttgcctcagggttcgtgctacccactgattccctttacccttagtaataattttggatcattttctttcctttaaaggggaacaaagccttttttttttttgagacggagtgttgctctgtcacccaagctggagtgcagtggcacgaatcttggctcactccaacctccaccttccaggttcaagtgattctcctgcctcagcctcccgagtagctgggactacgggcacgcaccaccacgtctggctaatttttgtatttttagtagagatggggtttcaccctattggtcaggctggtcttgaattcctcacctcaggtcatccgcctgtctcggcctcccgaagtgctgggattataggtgtgagccaccgcacccagttgggaacaaagcctttttaacacacgtaagggccctcaaaccgtgggacctctaaggagacctttgaagctttttgagggcaaactttacctttgtggtccccaaatgatggcatttctctttgaaatttattagatactgttatgtcccccaagggtacaggaggggcatccctcagcctatgggaacacccaaactaggaggggttattgacaggaaggaatgaatccaagtgaaggctttctgctcttcgtgttacaaaccagtttcagagttagctttctggggaggtgtgtgtttgtgaaaggaattcaagtgttgcaggacagatgagctcaaggtaaggtagctttggcagcagggctgatactatgaggctgaaacaatccttgtgatgaagtagatcatgcagtgacatacaaagaccaaggattatgtatatttttatatctctgtggttttgaaactttagtacttagaattttggccttctgcactactcttttgctcttacgaacataatggactcttaagaatggaaagggatgacatttacctatgtgtgctgcctcattcctggtgaagcaactgctacttgttctctatgcctctaaaatgatgctgttttctctgctaaaggtaaaagaaaagaaaaaaatagttggaaaataagacatgcaacttgatgtgcttttgagtaaatttatgcagcagaaactatacaatgaaggaagaattctatggaaattacaaatccaaaactctatgatgatgtcttcctagggagtagagaaaggcagtgaaatggcagttagaccaacagaggcttgaaggattcaagtacaagtaatattttgtataaaacatagcagtttaggtccccataatcctcaaaaatagtcacaaatataacaaagttcattgttttagggtttttaaaaaacgtgttgtacctaaggccatacttactcttctatgctatcactgcaaaggggtgatatgtatgtattatataaaaaaaaaaacccttaatgcactgttatctcctaaatatttagtaaattaatactatttaatttttttaaagatttgtctgtgtagacactaaaagtattacacaaaatctggactgaaggtgtcctttttaacaacaatttaaagtactttttatatatgttatgtagtatatcctttctaaactgcctagtttgtatattcctataattcctatttgtgaagtgtacctgttcttgtctcttttttcagtcattttctgcacgcatccccctttatatggttatagagatgactgtagcttttcgtgctccactgcgaggtttgtgctcagagccgctgcaccccagcgaggcctgctccatggagtgcaggacgagctactgctttggagcgagggtttcctgcttttgagttgacctgacttccttcttgaaatgactgttaaaactaaaataaattacattgcatttattttatattcttggttgaaataaaatttaattgactttg

SEQ ID NO: 354637 - DNA, 4972 bp, Homo sapiens
tgtggccgccgaggagtcccttgctgaaggcggaccgcggagcggcgggcggcgggcggcgcgcgcgcgcgcgcgagaggcggctgttggagaagtggagcggcggtcgcggggggaggaggaggagggactgagcggcggcggcccccgcgtcccgtgcctctatgggggaagcagacaatggattatgatttcaaggcgaagctggcggcggagcgggagcgggtggaggatttgtttgagtacgaagggtgcaaagtgggacgcggcacctacggtcacgtctacaaggcgaggcggaaagatggaaaagatgaaaaggaatatgcattgaagcaaattgaaggcacaggaatatccatgtcggcttgtagagagattgcacttttgcgagaattgaagcaccctaatgtgattgcattgcagaaggtgttcctttctcacagtgacaggaaggtatggctgctgtttgattatgcagagcatgacttgtggcatattattaagtttcaccgtgcatcaaaagcaaataaaaagcccatgcagttgccaagatctatggttaaatccttactttaccagattcttgatggtatccattacctccatgcaaattgggtgcttcacagagacttgaaaccagcaaatatcctagtaatgggagaaggtcctgagagggggagagtcaaaatagctgacatgggttttgccagattattcaattctcctctaaagccactagcagatttggatccagtagttgtgacattttggtatcgggctccagaacttttgcttggtgcaaggcattatacaaaggccattgatatatgggcaataggttgtatatttgctgaattgttgacttcggaacctatttttcactgtcgtcaggaagatataaaaacaagcaatccctttcatcatgatcaactggatcggatatttagtgtcatggggtttcctgcagataaagactgggaagatattagaaagatgccagaatatcccacacttcaaaaagactttagaagaacaacgtatgccaacagtagcctcataaagtacatggagaaacacaaggtcaagcctgacagcaaagtgttcctcttgcttcagaaactcctgaccatggatccaaccaagagaattacctcggagcaagctctgcaggatccctattttcaggaggaccctttgccaacattagatgtatttgccggctgccagattccataccccaaacgagaattccttaatgaagatgatcctgaagaaaaaggtgacaagaatcagcaacagcagcagaaccagcatcagcagcccacagcccctccacagcaggcagcagcccctccacaggcgcccccaccacagcagaacagcacccagaccaacgggaccgcaggtggggctggggccggggtcgggggcaccggagcagggttgcagcacagccaggactccagcctgaaccaggtgcctccaaacaagaagccacggctagggccttcaggcgcaaactcaggtggacctgtgatgccctcggattatcagcactccagttctcgcctgaattaccaaagcagcgttcagggatcctctcagtcccagagcacacttggctactcttcctcgtctcagcagagctcacagtaccacccatctcaccaggcccaccggtactgaccagctcccgttgggccaggccagcccagcccagagcacaggctccagcaatatgtctgcattgaaaagaaccaaaaaaatgcaaactatgatgccatttaaaactcatacacatgggaggaaaaccttatatactgagcattgtgcaggactgatagctcttctttattgacttaaagaagattcttgtgaagtttccccagcaccccttccctgcatgtgttccattgtgacttctctgataaagcgtctgatctaatcccagcacttctgtaaccttcagcatttctttgaaggatttcctggtgcacctttctcatgctgtagcaatcactatggtttatcttttcaaagctcttttaataggattttaatgttttagaaacaggattccagtggtgtatagttttatacttcatgaactgatttagcaacacaggtaaaaatgcaccttttaaagcactacgttttcacagacaataactgttctgctcatggaagtcttaaacagaaactgttactgtcccaaagtactttactattacgttcgtatttatctagtttcagggaaggtctaataaaaagacaagcggtgggacagagggaacctacaaccaaaaactgcctagatctttgcagttatgtgctttatgccacgaagaactgaagtatgtggtaatttttatagaatcattcatatggaactgagttcccagcatcatcttattctgaatagcattcagtaattaagaattacaattttaaccttcatgtagctaagtctaccttaaaaagggtttcaagagctttgtacagtctcgatggcccacaccaaaacgctgaagagagtaacaactgcactaggatttctgtaaggagtaattttgatcaaaagacgtgttacttccctttgaaggaaaagtttttagtgtgtattgtacataaagtcggcttctctaaagaaccattggtttcttcacatctgggtctgcgtgagtaactttcttgcataatcaaggttactcaagtagaagcctgaaaattaatctgcttttaaaataaagagcagtgttctccattcgtatttgtattagatatagagtgactatttttaaagcatgttaaaaatttaggttttattcatgtttaaagtatgtattatgtatgcataattttgctgttgttactgaaacttaattctatcaagaatctttttcattgcactgaatgatttcttttgcccctaggagaaaacttaataattgtgcctaaaaactatgggcggatagtataagactatactagacaaagtgaatatttgcatttccattatctatgaattagtggctgagttctttcttagctgctttaaggagcccctcactccccagagtcaaaaggaaatgtaaaaacttagagctcccattgtaatgtaaggggcaagaaatttgtgttcttctgaatgctactagcagcaccagccttgttttaaatgttttcttgagctagaagaaatagctgattattgtatatgcaaattacatgcatttttaaaaactattctttctgaacttatctacctggttatgatactgtgggtccatacacaagtaaaataagattagacagaagccagtatacattttgcactattgatgtgatactgtagccagccaggaccttactgatctcagcataataatgctcactaataatgaagtctgcatagtgacactcatcaagactgaagatgaagcaggttacgtgctccattggaaggagtttctgatagtctcctgctgttttaccccttccattttttaaaataagaaattagcagccctctgcataatgtagctgcctatatgcagttttatcctgtgccctaaagcctcactgtccagagctgttggtcatcagatgcttattgcaccctcaccatgtgcctggtgccctgctgggtagagaacacagaggacagggcatacttcttgtccttaaggagcttgtgatctgtgacagtaagccctcctgggatgtctgtgccatgtgattgacttacaagtgaaactgtcttataatatgaaggtctttttgtttacttctaaacccacttgggtagttactatccccaaatctgttctgtaaataatattatggaagggtttctatgtcagtctaccttagagaaagccagtgattcaatatcacaaaaggcattgacgtatctttgaaatgttcacagcagccttttaacaacaactgggtggtccttgtaggcagaacatactctcctaagtggttgtaggaaattgcaaggaaaatagaaggtctgttcttgctctcaaggaggttacctttaataaaagaagacaaacccagatagatatgtaaaccaaaatactatgccccttaatactttataagcagcattgttaaatagttcttacgcttatacattcacagaactaccctgttttccttgtatataatgacttttgctggcagaactgaaatataaactgtaaggggatttcgtcagttgctcccagtatacaatatcctccaggacatagccagaaatctccattccacacatgactgagttcctatccctgcactggtactggctcttttctcctctttccttgcctcagggttcgtgctacccactgattccctttacccttagtaataattttggatcattttctttcctttaaaggggaacaaagccttttttttttttgagacggagtgttgctctgtcacccaagctggagtgcagtggcacgaatcttggctcactccaacctccaccttccaggttcaagtgattctcctgcctcagcctcccgagtagctgggactacgggcacgcaccaccacgtctggctaatttttgtatttttagtagagatggggtttcaccctattggtcaggctggtcttgaattcctcacctcaggtcatccgcctgtctcggcctcccgaagtgctgggattataggtgtgagccaccgcacccagttgggaacaaagcctttttaacacacgtaagggccctcaaaccgtgggacctctaaggagacctttgaagctttttgagggcaaactttacctttgtggtccccaaatgatggcatttctctttgaaaggatcacccaggccagtctgaggataacaagaatataagagtctgagaagaagggaggttaattaggggttgattgtactagtctagcaagagatgtgcatagctttagactagagtgagaagta

SEQ ID NO: 354638 - DNA, 1843 bp, Homo sapiens
ggaggagtaggctcgctcgggtcctcgccctgcccgcgacctggcgggatgggtgggtcggatcccagtcgggccgtgcccgaggggcgaggcggagggggtcgcggggttgcgtccggacaccgactccgaggggcgcccgttccgcccgcctcccccgcgcggccccgtcgcgtacctcgaactcccgcggcgcagcccggtccgaggcgtcggtcccgtcccagaggggcgccctccgagtgctcggagacggcggggggactcgagttgggaccgcggtggaggaggagtttgtggggtctagtctcttgggggaacgcagcgggcaggcagagctccgctgcggagttgccgctccggccctgggtagtgacggtcgttgtggaacttccaatcggctgagcgcctcgcgggggcggcggtttgaaacctcgccggggagcctgtcgggcgaacgcggcctggggtcctcgccagccccacggctctgacccgctgggcaccgccgcccccagcagcgatctccgcccttcgggctggccggcccgttggcttctctatgcagtcctcccatccctgttgtatgcccggcgtcccgggtttctcattctcacattctgaattgcgtaccttcccccttcgaaggagacctgatgggctagctgcgtttcgcaagcggcaacttaagagttggctgaattctctgctacccaccctttaccttgcagccccttgggtatcttgggtattatgtcctccactccatcctctgccagatgactgtgggctggggcttatggagtacctatattatcaagaacggaatacgaagtgacagagctgggcctgaacctttgttttcctaggagttgagggagaactgtaggaacaccttgggaagcctttactggttgtcctcttaagaagagctggataatgtactgagaatacctgtcctttcttggtcctggagggcagacagcagctacagcaggactggtggaaccagcttcctggcaggaattaccctcccccaaagctagggacccaggaagatgccctgtccagcatagactttaaagagagtcaaactctacggaagaggattgtaacggaccatttctgaataaagtgatgatcagccacaatgacattagtaaaatttgaagtgccgcttatctttgtgcgtgctgttataatttgatgtggttggtatatgaactctaggactaaagtacgttgtgtgcgtatgcactaacttcataaaacaactctattataaagtgttttgtcataaggtatcgtgaaaattgcaaagtgctatccaagtgtaaaggattattattattgcagaattttttttttcttttgtaactgaacaggccttaaggtactcagttgtttctcataattcctttaattaccaggtgtccttgaatgcttatcatggaatgtgagatactataattaacatattttggttttggaatatccactccacctgttatactagtgttcttgtgggaattttatcagttatatttggggaaagcacatccagttttccgtttggacattgttaataaatctgaggtgggtttttcccatactcctcatgctaactttgtggtatacttttggttttaaaaaatgtatcttagtgttttttttgttaaaatagctttcttttattagggaacttttgagaagttaaaaattctgcttctgaattgtatttgaatagtatgggcttacaacaaaaaccagataattcttgcttctattctttttgaatatttttcccctctaataaagtacttgattcgaatacacttccttt

SEQ ID NO: 354639 - DNA, 682 bp, Homo sapiens
ctgccacgagtgagacaggtgcttctgtttccactcggggcagccacttcgtgggcagcgctgcccacgaagtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggactta

SEQ ID NO: 354640 - DNA, 1215 bp, Homo sapiens
gaagactgaataagccgtgaactgggcagctgtgacacgcgcaccttgtcaccttgtcaccaatttcctgcccgggatcccagagctacccttcttggagcccacaggggaataaagtgaaacacctcaggctccaaccctcccaacccaaggctccctcctggagggagagagaggatggaggacatcaggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggactta

SEQ ID NO: 354641 - DNA, 1133 bp, Homo sapiens
gaagactgaataagccgtgaactgggcagctgtgacacgcgcaccttgtcaccttgtcaccaatttcctgcccgggatcccagagctacccttcttggagcccacaggggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggactta

SEQ ID NO: 354642 - DNA, 1223 bp, Homo sapiens
gactgggttatgccctgcttatcagcagcttcccagcttcctctgcctggattcttagaggcctggggtcctagaacgagctggtgcacgtggcttcccaaagatctctcagataatgagaggaaatgcagtcatcagtttgcagaaggctagggattctgggccatagctcagacctgcgcccaccatctccctccaggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggactta

SEQ ID NO: 354643 - DNA, 1069 bp, Homo sapiens
gaagactgaataagccgtgaactgggcagctgtgacacgcgcaccttgtcaccttgtcaccaatttcctgcccgggatcccagagctacccttcttggagcccacaggggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggactta

SEQ ID NO: 354644 - DNA, 1064 bp, Homo sapiens
gcttctgcggattcctccctaggaataaagtgaaacacctcaggctccaaccctcccaacccaaggctccctcctggagggagagagaggatggaggacatcaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggactta

SEQ ID NO: 354645 - DNA, 1099 bp, Homo sapiens
gactgggttatgccctgcttatcagcagcttcccagcttcctctgcctggattcttagaggcctggggtcctagaacgagctggtgcacgtggcttcccaaagatctctcagataatgagaggaaatgcagtcatcagtttgcagaaggctagggattctgggccatagctcagacctgcgcccaccatctccctccaggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtcgccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggactta

SEQ ID NO: 354646 - DNA, 1096 bp, Homo sapiens
gaagactgaataagccgtgaactgggcagctgtgacacgcgcaccttgtcaccttgtcaccaatttcctgcccgggatcccagagctacccttcttggagcccacagggtaaggttgagcttctcactttccctccaatgaagcatggcagcatgggaaggattttggcagtgtcgaggtctgagttttagtccgttcccctctctgggtctcagtttctcgctggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggactta

SEQ ID NO: 354647 - DNA, 755 bp, Homo sapiens
gaagactgaataagccgtgaactgggcagctgtgacacgcgcaccttgtcaccttgtcaccaatttcctgcccgggatcccagagctacccttcttggagcccacagggtaaggttgagcttctcactttccctccaatgaagcatggcagcatgggaaggattttggcagtgtcgaggtctgagttttagtccgttcccctctctgggtctcagtttctcgctggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccgtgagtggctgtgctgcggggccctcctctcccctgggacagaggctgtgtctactgaatgcacacagagcccctctgtgcctgctcctgggcactgtcatcgtggggccctgcctccctgagctcctggggtgacaaggggcaggaccaggccagcc

SEQ ID NO: 354648 - DNA, 728 bp, Homo sapiens
gaagactgaataagccgtgaactgggcagctgtgacacgcgcaccttgtcaccttgtcaccaatttcctgcccgggatcccagagctacccttcttggagcccacaggggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggactta

SEQ ID NO: 354649 - DNA, 1025 bp, Homo sapiens
gactgggttatgccctgcttatcagcagcttcccagcttcctctgcctggattcttagaggcctggggtcctagaacgagctggtgcacgtggcttcccaaagatctctcagataatgagaggaaatgcagtcatcagtttgcagaaggctagggattctgggccatagctcagacctgcgcccaccatctccctccaggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagctgtgtcggacagccgatggtcatcataagtcaccgggggcggggtgtggcctggttgggaatttgtctggttggttatcttcggcagattgggcagagggatgggcctagggtggaaggtgtgggagggc

SEQ ID NO: 354650 - DNA, 1249 bp, Homo sapiens
gaagactgaataagccgtgaactgggcagctgtgacacgcgcaccttgtcaccttgtcaccaatttcctgcccgggatcccagagctacccttcttggagcccacagggtaaggttgagcttctcactttccctccaatgaagcatggcagcatgggaaggattttggcagtgtcgaggtctgagttttagtccgttcccctctctgggtctcagtttctcgctggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggactta

SEQ ID NO: 354651 - DNA, 1365 bp, Homo sapiens
gaagactgaataagccgtgaactgggcagctgtgacacgcgcaccttgtcaccttgtcaccaatttcctgcccgggatcccagagctacccttcttggagcccacagggtaaggttgagcttctcactttccctccaatgaagcatggcagcatgggaaggattttggcagtgtcgaggtctgagttttagtccgttcccctctctgggtctcagtttctcgctggcagcccttggctggtccctgcgagcccgtggagactgccagagatgtcctctttcggttacaggaccctgactgtggccctcttcaccctgatctgctgtccagacagggtctcggtctatcacccaggctggagtacagtggcatgatcatggctcactgcacctccctgggctcgggtgatcctcccacctcagcctcctgagtagctgggatcacaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggactta

SEQ ID NO: 354652 - DNA, 1299 bp, Homo sapiens
gaagactgaataagccgtgaactgggcagctgtgacacgcgcaccttgtcaccttgtcaccaatttcctgcccgggatcccagagctacccttcttggagcccacaggggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccttggctgtacaatttctgaaccttgtccttgtagacacctggtcaccggaaaccatcatgtctgtaaaactaccacacagtccagcctccatcctcaactgctgccctcttcctctctgcactggagccggccaggccacctcctccccaaccgtggaacaccatgagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggactta

SEQ ID NO: 354653 - DNA, 1215 bp, Homo sapiens
gaagactgaataagccgtgaactgggcagctgtgacacgcgcaccttgtcaccttgtcaccaatttcctgcccgggatcccagagctacccttcttggagcccacaggggaataaagtgaaacacctcaggctccaaccctcccaacccaaggctccctcctggagggagagagaggatggaggacatcaggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccccctcgcctgcctttgtcccccggcgtcagtcctgggccttttgttgctgcggcggtgggtgccctgttggctcccgctgagaatgtgagcactgccttctctagttcgaatacattcacttgtgtgtc

SEQ ID NO: 354654 - DNA, 252 bp, Homo sapiens
ggtagttaaacgtaacatacttacttaaaggaatccaaatctacttgaaaaacaaaacacaaacacgtttgtttcagactcagcctgtgggttgtcagttttcaaccccttgggttaaagaacaaagggcatgagaccatagtcaataacccccatctaccaggcagactgtcaaatcagctttttttaaaaaaatagccttactcttaaatatgagcagacaatcagatacctgaagaaaactgttaccat

SEQ ID NO: 354655 - DNA, 3296 bp, Homo sapiens
ggccggaccctgcgagaacgggtgggcgtgtgcccggtgggcgcgggaggggcccgggctgcacgagcgcgcgtgcgcgtcggaactggagccgcgggaggaggcgggagctgaggaggcggcggagggggcgggtcgcgtcgggcgccacgtccgcagccagaggcctccgcctccaccaccgccgccacagtcttccagctccacatcctgagaggacgcctctggagccgcgactgcccggggttgtgccggccgccgctgccgcccaggccgcctcagctctcctctgcgccggcccgctcactccgcccggccccagccctagcgctggccgcgaccccggcggagatcatgaatcagacagataaaaatcaacaagaaatcccatcataccttaatgatgaaccaccagaaggttcaatgaaagatcacccacagcagcagccaggcatgttgtcccgtgtgactgggggtatcttcagtgttacaaagggagctgttggtgccaccattggtggtgtggcttggattggtggaaagagtctggaagtgaccaaaacagctgttacaactgtgccttccatgggaatagggctggtgaaagggggtgtctctgctgtggctggaggtgttacagctgttgggtctgctgttgtaaacaaagtgcccttaacaggaaagaagaaagacaaatctgactgaaatatagagatacacttgcgctccacagcactgtaatgccagtggcattgaattgctaaattatggactacaaccaagtcaactgttttggacgtttatcttctaaactgctgtgttgaaagtattgatgactggctttcatctaaaaagaagagaccaatacgagcacagtatatgaaggtttctcatacttaagttccaggtttttatctggtaaaatgttacacttactcggttgtaactgaagatatggtatgtttgaatatttactataagtctttcagtttgactaaaaatgtgaaagttgaatttagtagatgatcttcacagttccatatgtataatgtgccaggtaactcacctgccccttaagaagggaaccttgaattacataagccgtacctttgatgtgcctaatagtttcagatgtcttagttttttataaccatagttgattaggccaagaggcattcatttcttatttaagctggcaaaattagcaggaattagagaagtttaaaaagataaatggttttatgataatgttaaccatcttttgttagtaaatatgcgttctattattttaatcattgatgccttacaaaagaaaacatcttttctaataccctgaatatgtgctgttcttagaatcatctatggattcttttaaaggttgtttgtgaaattagttttccctttttagaatctcaggagtagtggggtaaagacatttcctgctgtcagtggataagacagagcttgttaactgttttggcagtagttaaaatcaaattgtacacttctcagcctgggttcatgcttcatcattaatacacctcacagtgcctaaggaacatttacttactggtcagaaggtattttggaagagtttcatattaaggaggaacaaataataattttaagttcttaaaaattacctaaaacaccccaaatataaaaagaagccttcacacctattctgtctttaggatgtcttaaattattagcagtactccttttttaaaaacactgtaaaagtaaccacaaatatgtgaggacttactattttaaatggaatggaatgagctccatagattagttttgaatataaagtatataaaagtgcatcagtggtttatataggctttaaaaacatgttatcttacagtcctttaaagcagccatagagtttgtatcatttttcaagccaatttcagtcagggatttgaattgtttgattatggatgataaatgtgtcatatcttattaatatgtctcatgtctcgttccttcttaatatgatttagctggaattcattttcttttcgtttcatgtttaatttcataaaacgtttaacaattggcatatatacttggcattcctgtccaccaaggattgtaatccaagcctgggaaaatcttaaatttctttttacttaaatctggaaatttgtctccattctgccacctttttttttttttttttttatagtggaggggaggaaaggggggtgataccttgcagtaagtaagtcgaaatagcatgcctgaaaatttgaaacagaccattctaacacccaaggcttgtttataaaatacttgagaattacattaatgtggaatcaacagatgcagaagaatataacataacttttaaaagctttcataaataccagcagcaattgtaagcaaatctacaaaggttcttgaacctttctattatatacaaaactgaaaagtcattaaggagttcaactaatcaggaattaaatggtcatttatttcatgcagtatgatttaaggtatttcttgagattctggtcaaatgtcataatcagcaaacgggattaaaaaaaaaactccaaaatcactaaataattatctaaataatggtattggagaacttgtttcctgctatttggaagagattgttgcttcattgctagtttgtatttctaacttctacagttatagactccactgtgctttgtgtctgaatttctcagtatagacattttgtttactgtatgcttgcatatttattttcaactttgcctgtctttaaaattgcttgaggaaaaatggttgtaattaatttctgctacagaaaagccacctggtacgttttgtctcatcaggattgttttaaattctaaactataagtttgttcagaggggcttttgcaatgatagcagaaaactgtacaaatgtacagttagttatagaggttcttgttgaaatgaacttaccatctgatgatatgtatgtacagctgtgtacttgagtcttttttagtttacttagaaagactagcagtttgacctgttaaacaggactagttcaagtcaagaaactaaggttgttgtatacacctggaggcatctgttattcagcttatcctttgagtgggtatttggcacaatgaggataaacttatgtgacccacttgaatggctgatctaataatgttgacattatgcattctgtacttagtgaaatgtcagatgaaaataactgatgaataatttttttgtattaaagggatgggaaaagaacacatgaatttgttaataaagcactatgatctgca

SEQ ID NO: 354656 - DNA, 438 bp, Homo sapiens
ttttctaaaaagctccatttatttcaaatgtatataaattagataattttgaattagaacactttatagagaggttttcataaatgtccccgaatttgttgttagtacttattccttttggcctgtcaggtaggggtgacttctcttatgccaattcataagtaatccttccagttcacaaggtttaaacagaagtcagagcccagttaataaacccagactctgccatttggcagctgagtggcctctcagcttcagtttcctcatgtgtaaaatgaggaaagtaatgaatgcacatggtgttttataagagttataataatggtcaattctaagcaaactgaccacacaagtaggctccaactcttctttttggatgagtaatacttgattctcaaagacagtaatttattccaaacacaagatgaaattttctcc

SEQ ID NO: 354657 - DNA, 3030 bp, Homo sapiens
aatgtgtttgtatgtttttttttttaggagatcatgaatcagacagataaaaatcaacaagaaatcccatcataccttaatgatgaaccaccagaaggttcaatgaaagatcacccacagcagcagccaggcatgttgtcccgtgtgactgggggtatcttcagtgttacaaagggagctgttggtgccaccattggtggtgtggcttggattggtggaaagagtctggaagtgaccaaaacagctgttacaactgtgccttccatgggaatagggctggtgaaagggggtgtctctgctgtggctggaggtgttacagctgttgggtctgctgttgtaaacaaagtgcccttaacaggaaagaagaaagacaaatctgactgaaatatagagatacacttgcgctccacagcactgtaatgccagtggcattgaattgctaaattatggactacaaccaagtcaactgttttggacgtttatcttctaaactgctgtgttgaaagtattgatgactggctttcatctaaaaagaagagaccaatacgagcacagtatatgaaggtttctcatacttaagttccaggtttttatctggtaaaatgttacacttactcggttgtaactgaagatatggtatgtttgaatatttactataagtctttcagtttgactaaaaatgtgaaagttgaatttagtagatgatcttcacagttccatatgtataatgtgccaggtaactcacctgccccttaagaagggaaccttgaattacataagccgtacctttgatgtgcctaatagtttcagatgtcttagttttttataaccatagttgattaggccaagaggcattcatttcttatttaagctggcaaaattagcaggaattagagaagtttaaaaagataaatggttttatgataatgttaaccatcttttgttagtaaatatgcgttctattattttaatcattgatgccttacaaaagaaaacatcttttctaataccctgaatatgtgctgttcttagaatcatctatggattcttttaaaggttgtttgtgaaattagttttccctttttagaatctcaggagtagtggggtaaagacatttcctgctgtcagtggataagacagagcttgttaactgttttggcagtagttaaaatcaaattgtacacttctcagcctgggttcatgcttcatcattaatacacctcacagtgcctaaggaacatttacttactggtcagaaggtattttggaagagtttcatattaaggaggaacaaataataattttaagttcttaaaaattacctaaaacaccccaaatataaaaagaagccttcacacctattctgtctttaggatgtcttaaattattagcagtactccttttttaaaaacactgtaaaagtaaccacaaatatgtgaggacttactattttaaatggaatggaatgagctccatagattagttttgaatataaagtatataaaagtgcatcagtggtttatataggctttaaaaacatgttatcttacagtcctttaaagcagccatagagtttgtatcatttttcaagccaatttcagtcagggatttgaattgtttgattatggatgataaatgtgtcatatcttattaatatgtctcatgtctcgttccttcttaatatgatttagctggaattcattttcttttcgtttcatgtttaatttcataaaacgtttaacaattggcatatatacttggcattcctgtccaccaaggattgtaatccaagcctgggaaaatcttaaatttctttttacttaaatctggaaatttgtctccattctgccacctttttttttttttttttttatagtggaggggaggaaaggggggtgataccttgcagtaagtaagtcgaaatagcatgcctgaaaatttgaaacagaccattctaacacccaaggcttgtttataaaatacttgagaattacattaatgtggaatcaacagatgcagaagaatataacataacttttaaaagctttcataaataccagcagcaattgtaagcaaatctacaaaggttcttgaacctttctattatatacaaaactgaaaagtcattaaggagttcaactaatcaggaattaaatggtcatttatttcatgcagtatgatttaaggtatttcttgagattctggtcaaatgtcataatcagcaaacgggattaaaaaaaaaactccaaaatcactaaataattatctaaataatggtattggagaacttgtttcctgctatttggaagagattgttgcttcattgctagtttgtatttctaacttctacagttatagactccactgtgctttgtgtctgaatttctcagtatagacattttgtttactgtatgcttgcatatttattttcaactttgcctgtctttaaaattgcttgaggaaaaatggttgtaattaatttctgctacagaaaagccacctggtacgttttgtctcatcaggattgttttaaattctaaactataagtttgttcagaggggcttttgcaatgatagcagaaaactgtacaaatgtacagttagttatagaggttcttgttgaaatgaacttaccatctgatgatatgtatgtacagctgtgtacttgagtcttttttagtttacttagaaagactagcagtttgacctgttaaacaggactagttcaagtcaagaaactaaggttgttgtatacacctggaggcatctgttattcagcttatcctttgagtgggtatttggcacaatgaggataaacttatgtgacccacttgaatggctgatctaataatgttgacattatgcattctgtacttagtgaaatgtcagatgaaaataactgatgaataatttttttgtattaaagggatgggaaaagaacacatgaatttgttaataaagcactatgatctgcaaacgatggaatgtttcataaagatctaaagaaataaaggaaactttaaaacagag

SEQ ID NO: 354658 - DNA, 3351 bp, Homo sapiens
ggccggaccctgcgagaacgggtgggcgtgtgcccggtgggcgcgggaggggcccgggctgcacgagcgcgcgtgcgcgtcggaactggagccgcgggaggaggcgggagctgaggaggcggcggagggggcgggtcgcgtcgggcgccacgtccgcagccagaggcctccgcctccaccaccgccgccacagtcttccagctccacatcctgagaggacgcctctggagccgcgactgcccggggttgtgccggccgccgctgccgcccaggccgcctcagctctcctctgcgccggcccgctcactccgcccggccccagccctagcgctggccgcgaccccggcggagatcatgaatcagacagataaaaatcaacaagaaatcccatcataccttaatgatgaaccaccagaaggttcaatgaaagatcacccacagcagcagccaggcatgttgtcccgtgtgactgggggtatcttcagtgttacaaagggagctgttggtgccaccattggtggtgtggcttggattggtggaaagagtctggaagtgaccaaaacagctgttacaactgtgccttccatgggaatagggctggtgaaagggggtgtctctgctgtggctggaggtgttacagctgttgggtctgctgttgtaaacaaagtgcccttaacaggaaagaagaaagacaaatctgactgaaatatagagatacacttgcgctccacagcactgtaatgccagtggcattgaattgctaaattatggactacaaccaagtcaactgttttggacgtttatcttctaaactgctgtgttgaaagtattgatgactggctttcatctaaaaagaagagaccaatacgagcacagtatatgaaggtttctcatacttaagttccaggtttttatctggtaaaatgttacacttactcggttgtaactgaagatatggtatgtttgaatatttactataagtctttcagtttgactaaaaatgtgaaagttgaatttagtagatgatcttcacagttccatatgtataatgtgccaggtaactcacctgccccttaagaagggaaccttgaattacataagccgtacctttgatgtgcctaatagtttcagatgtcttagttttttataaccatagttgattaggccaagaggcattcatttcttatttaagctggcaaaattagcaggaattagagaagtttaaaaagataaatggttttatgataatgttaaccatcttttgttagtaaatatgcgttctattattttaatcattgatgccttacaaaagaaaacatcttttctaataccctgaatatgtgctgttcttagaatcatctatggattcttttaaaggttgtttgtgaaattagttttccctttttagaatctcaggagtagtggggtaaagacatttcctgctgtcagtggataagacagagcttgttaactgttttggcagtagttaaaatcaaattgtacacttctcagcctgggttcatgcttcatcattaatacacctcacagtgcctaaggaacatttacttactggtcagaaggtattttggaagagtttcatattaaggaggaacaaataataattttaagttcttaaaaattacctaaaacaccccaaatataaaaagaagccttcacacctattctgtctttaggatgtcttaaattattagcagtactccttttttaaaaacactgtaaaagtaaccacaaatatgtgaggacttactattttaaatggaatggaatgagctccatagattagttttgaatataaagtatataaaagtgcatcagtggtttatataggctttaaaaacatgttatcttacagtcctttaaagcagccatagagtttgtatcatttttcaagccaatttcagtcagggatttgaattgtttgattatggatgataaatgtgtcatatcttattaatatgtctcatgtctcgttccttcttaatatgatttagctggaattcattttcttttcgtttcatgtttaatttcataaaacgtttaacaattggcatatatacttggcattcctgtccaccaaggattgtaatccaagcctgggaaaatcttaaatttctttttacttaaatctggaaatttgtctccattctgccacctttttttttttttttttttatagtggaggggaggaaaggggggtgataccttgcagtaagtaagtcgaaatagcatgcctgaaaatttgaaacagaccattctaacacccaaggcttgtttataaaatacttgagaattacattaatgtggaatcaacagatgcagaagaatataacataacttttaaaagctttcataaataccagcagcaattgtaagcaaatctacaaaggttcttgaacctttctattatatacaaaactgaaaagtcattaaggagttcaactaatcaggaattaaatggtcatttatttcatgcagtatgatttaaggtatttcttgagattctggtcaaatgtcataatcagcaaacgggattaaaaaaaaaactccaaaatcactaaataattatctaaataatggtattggagaacttgtttcctgctatttggaagagattgttgcttcattgctagtttgtatttctaacttctacagttatagactccactgtgctttgtgtctgaatttctcagtatagacattttgtttactgtatgcttgcatatttattttcaactttgcctgtctttaaaattgcttgaggaaaaatggttgtaattaatttctgctacagaaaagccacctggtacgttttgtctcatcaggattgttttaaattctaaactataagtttgttcagaggggcttttgcaatgatagcagaaaactgtacaaatgtacagttagttatagaggttcttgttgaaatgaacttaccatctgatgatatgtatgtacagctgtgtacttgagtcttttttagtttacttagaaagactagcagtttgacctgttaaacaggactagttcaagtcaagaaactaaggttgttgtatacacctggaggcatctgttattcagcttatcctttgagtgggtatttggcacaatgaggataaacttatgtgacccacttgaatggctgatctaataatgttgacattatgcattctgtacttagtgaaatgtcagatgaaaataactgatgaataatttttttgtattaaagggatgggaaaagaacacatgaatttgttaataaagcactatgatctgcaaacgatggaatgtttcataaagatctaaagaaataaaggaaactttaaaacagag

SEQ ID NO: 354659 - DNA, 3517 bp, Homo sapiens
ggccggaccctgcgagaacgggtgggcgtgtgcccggtgggcgcgggaggggcccgggctgcacgagcgcgcgtgcgcgtcggaactggagccgcgggaggaggcgggagctgaggaggcggcggagggggcgggtcgcgtcgggcgccacgtccgcagccagaggcctccgcctccaccaccgccgccacagtcttccagctccacatcctgagaggacgcctctggagccgcgactgcccggggttgtgccggccgccgctgccgcccaggccgcctcagctctcctctgcgccggcccgctcactccgcccggccccagccctagcgctggccgcgaccccggcgcctttgaaacttctgctggtgtgagtgccctcaggggttccccaggaatatcgatacaacaccaacaggctggagtgcagtggcttgatctccactcactgcaacatccgtctcccaggttcaagagattttcctgcctcagcctccctggtagctgggattacaggagatcatgaatcagacagataaaaatcaacaagaaatcccatcataccttaatgatgaaccaccagaaggttcaatgaaagatcacccacagcagcagccaggcatgttgtcccgtgtgactgggggtatcttcagtgttacaaagggagctgttggtgccaccattggtggtgtggcttggattggtggaaagagtctggaagtgaccaaaacagctgttacaactgtgccttccatgggaatagggctggtgaaagggggtgtctctgctgtggctggaggtgttacagctgttgggtctgctgttgtaaacaaagtgcccttaacaggaaagaagaaagacaaatctgactgaaatatagagatacacttgcgctccacagcactgtaatgccagtggcattgaattgctaaattatggactacaaccaagtcaactgttttggacgtttatcttctaaactgctgtgttgaaagtattgatgactggctttcatctaaaaagaagagaccaatacgagcacagtatatgaaggtttctcatacttaagttccaggtttttatctggtaaaatgttacacttactcggttgtaactgaagatatggtatgtttgaatatttactataagtctttcagtttgactaaaaatgtgaaagttgaatttagtagatgatcttcacagttccatatgtataatgtgccaggtaactcacctgccccttaagaagggaaccttgaattacataagccgtacctttgatgtgcctaatagtttcagatgtcttagttttttataaccatagttgattaggccaagaggcattcatttcttatttaagctggcaaaattagcaggaattagagaagtttaaaaagataaatggttttatgataatgttaaccatcttttgttagtaaatatgcgttctattattttaatcattgatgccttacaaaagaaaacatcttttctaataccctgaatatgtgctgttcttagaatcatctatggattcttttaaaggttgtttgtgaaattagttttccctttttagaatctcaggagtagtggggtaaagacatttcctgctgtcagtggataagacagagcttgttaactgttttggcagtagttaaaatcaaattgtacacttctcagcctgggttcatgcttcatcattaatacacctcacagtgcctaaggaacatttacttactggtcagaaggtattttggaagagtttcatattaaggaggaacaaataataattttaagttcttaaaaattacctaaaacaccccaaatataaaaagaagccttcacacctattctgtctttaggatgtcttaaattattagcagtactccttttttaaaaacactgtaaaagtaaccacaaatatgtgaggacttactattttaaatggaatggaatgagctccatagattagttttgaatataaagtatataaaagtgcatcagtggtttatataggctttaaaaacatgttatcttacagtcctttaaagcagccatagagtttgtatcatttttcaagccaatttcagtcagggatttgaattgtttgattatggatgataaatgtgtcatatcttattaatatgtctcatgtctcgttccttcttaatatgatttagctggaattcattttcttttcgtttcatgtttaatttcataaaacgtttaacaattggcatatatacttggcattcctgtccaccaaggattgtaatccaagcctgggaaaatcttaaatttctttttacttaaatctggaaatttgtctccattctgccacctttttttttttttttttttatagtggaggggaggaaaggggggtgataccttgcagtaagtaagtcgaaatagcatgcctgaaaatttgaaacagaccattctaacacccaaggcttgtttataaaatacttgagaattacattaatgtggaatcaacagatgcagaagaatataacataacttttaaaagctttcataaataccagcagcaattgtaagcaaatctacaaaggttcttgaacctttctattatatacaaaactgaaaagtcattaaggagttcaactaatcaggaattaaatggtcatttatttcatgcagtatgatttaaggtatttcttgagattctggtcaaatgtcataatcagcaaacgggattaaaaaaaaaactccaaaatcactaaataattatctaaataatggtattggagaacttgtttcctgctatttggaagagattgttgcttcattgctagtttgtatttctaacttctacagttatagactccactgtgctttgtgtctgaatttctcagtatagacattttgtttactgtatgcttgcatatttattttcaactttgcctgtctttaaaattgcttgaggaaaaatggttgtaattaatttctgctacagaaaagccacctggtacgttttgtctcatcaggattgttttaaattctaaactataagtttgttcagaggggcttttgcaatgatagcagaaaactgtacaaatgtacagttagttatagaggttcttgttgaaatgaacttaccatctgatgatatgtatgtacagctgtgtacttgagtcttttttagtttacttagaaagactagcagtttgacctgttaaacaggactagttcaagtcaagaaactaaggttgttgtatacacctggaggcatctgttattcagcttatcctttgagtgggtatttggcacaatgaggataaacttatgtgacccacttgaatggctgatctaataatgttgacattatgcattctgtacttagtgaaatgtcagatgaaaataactgatgaataatttttttgtattaaagggatgggaaaagaacacatgaatttgttaataaagcactatgatctgcaaacgatggaatgtttcataaagatctaaagaaataaaggaaactttaaaacagag

SEQ ID NO: 354660 - DNA, 2983 bp, Homo sapiens
gcagatcatgaggtcaggagatcgagaccatcctggccaacatggtgaaaccccgtctctactaaaaatataaaaattaccaggcatgttgtcccgtgtgactgggggtatcttcagtgttacaaagggagctgttggtgccaccattggtggtgtggcttggattggtggaaagagtctggaagtgaccaaaacagctgttacaactgtgccttccatgggaatagggctggtgaaagggggtgtctctgctgtggctggaggtgttacagctgttgggtctgctgttgtaaacaaagtgcccttaacaggaaagaagaaagacaaatctgactgaaatatagagatacacttgcgctccacagcactgtaatgccagtggcattgaattgctaaattatggactacaaccaagtcaactgttttggacgtttatcttctaaactgctgtgttgaaagtattgatgactggctttcatctaaaaagaagagaccaatacgagcacagtatatgaaggtttctcatacttaagttccaggtttttatctggtaaaatgttacacttactcggttgtaactgaagatatggtatgtttgaatatttactataagtctttcagtttgactaaaaatgtgaaagttgaatttagtagatgatcttcacagttccatatgtataatgtgccaggtaactcacctgccccttaagaagggaaccttgaattacataagccgtacctttgatgtgcctaatagtttcagatgtcttagttttttataaccatagttgattaggccaagaggcattcatttcttatttaagctggcaaaattagcaggaattagagaagtttaaaaagataaatggttttatgataatgttaaccatcttttgttagtaaatatgcgttctattattttaatcattgatgccttacaaaagaaaacatcttttctaataccctgaatatgtgctgttcttagaatcatctatggattcttttaaaggttgtttgtgaaattagttttccctttttagaatctcaggagtagtggggtaaagacatttcctgctgtcagtggataagacagagcttgttaactgttttggcagtagttaaaatcaaattgtacacttctcagcctgggttcatgcttcatcattaatacacctcacagtgcctaaggaacatttacttactggtcagaaggtattttggaagagtttcatattaaggaggaacaaataataattttaagttcttaaaaattacctaaaacaccccaaatataaaaagaagccttcacacctattctgtctttaggatgtcttaaattattagcagtactccttttttaaaaacactgtaaaagtaaccacaaatatgtgaggacttactattttaaatggaatggaatgagctccatagattagttttgaatataaagtatataaaagtgcatcagtggtttatataggctttaaaaacatgttatcttacagtcctttaaagcagccatagagtttgtatcatttttcaagccaatttcagtcagggatttgaattgtttgattatggatgataaatgtgtcatatcttattaatatgtctcatgtctcgttccttcttaatatgatttagctggaattcattttcttttcgtttcatgtttaatttcataaaacgtttaacaattggcatatatacttggcattcctgtccaccaaggattgtaatccaagcctgggaaaatcttaaatttctttttacttaaatctggaaatttgtctccattctgccacctttttttttttttttttttatagtggaggggaggaaaggggggtgataccttgcagtaagtaagtcgaaatagcatgcctgaaaatttgaaacagaccattctaacacccaaggcttgtttataaaatacttgagaattacattaatgtggaatcaacagatgcagaagaatataacataacttttaaaagctttcataaataccagcagcaattgtaagcaaatctacaaaggttcttgaacctttctattatatacaaaactgaaaagtcattaaggagttcaactaatcaggaattaaatggtcatttatttcatgcagtatgatttaaggtatttcttgagattctggtcaaatgtcataatcagcaaacgggattaaaaaaaaaactccaaaatcactaaataattatctaaataatggtattggagaacttgtttcctgctatttggaagagattgttgcttcattgctagtttgtatttctaacttctacagttatagactccactgtgctttgtgtctgaatttctcagtatagacattttgtttactgtatgcttgcatatttattttcaactttgcctgtctttaaaattgcttgaggaaaaatggttgtaattaatttctgctacagaaaagccacctggtacgttttgtctcatcaggattgttttaaattctaaactataagtttgttcagaggggcttttgcaatgatagcagaaaactgtacaaatgtacagttagttatagaggttcttgttgaaatgaacttaccatctgatgatatgtatgtacagctgtgtacttgagtcttttttagtttacttagaaagactagcagtttgacctgttaaacaggactagttcaagtcaagaaactaaggttgttgtatacacctggaggcatctgttattcagcttatcctttgagtgggtatttggcacaatgaggataaacttatgtgacccacttgaatggctgatctaataatgttgacattatgcattctgtacttagtgaaatgtcagatgaaaataactgatgaataatttttttgtattaaagggatgggaaaagaacacatgaatttgttaataaagcactatgatctgcaaacgatggaatgtttcataaagatctaaagaaataaaggaaactttaaaacagag

SEQ ID NO: 354661 - DNA, 1910 bp, Homo sapiens
ggccggaccctgcgagaacgggtgggcgtgtgcccggtgggcgcgggaggggcccgggctgcacgagcgcgcgtgcgcgtcggaactggagccgcgggaggaggcgggagctgaggaggcggcggagggggcgggtcgcgtcgggcgccacgtccgcagccagaggcctccgcctccaccaccgccgccacagtcttccagctccacatcctgagaggacgcctctggagccgcgactgcccggggttgtgccggccgccgctgccgcccaggccgcctcagctctcctctgcgccggcccgctcactccgcccggccccagccctagcgctggccgcgaccccggcgcctttgaaacttctgctggtgtgagtgccctcaggggttccccaggaatatcgatacaacaccaacaggagatcatgaatcagacagataaaaatcaacaagaaatcccatcataccttaatgatgaaccaccagaaggttcaatgaaagatcacccacagcagcagccaggcatgttgtcccgtgtgactgggggtatcttcagtgttacaaagggagctgttggtgccaccattggtggtgtggcttggattggtggaaagagtctggaagtgaccaaaacagctgttacaactgtgccttccatgggaatagggctggtgaaagggggtgtctctgctgtggctggaggtgttacagctgttgggtctgctgttgtaaacaaagtgcccttaacaggaaagaagaaagacaaatctgactgaaatatagagatacacttgcgctccacagcactgtaatgccagtggcattgaattgctaaattatggactacaaccaagtcaactgttttggacgtttatcttctaaactgctgtgttgaaagtattgatgactggctttcatctaaaaagaagagaccaatacgagcacagtatatgaaggtttctcatacttaagttccaggtttttatctggtaaaatgttacacttactcggttgtaactgaagatatggaagatctgagttagaatgtatgaatggaaaaaaaaggcaaagcagaacaatttcagaggttcaagagccaaaagcaatggaatggaccctaagggaaaataaaatggacctgtgctgcctctttcctcttgtgccactctcccaatcactcaaccctgctccaactgtactggctgctattcttcttgaacaaaccttcctgcatgaccttggaccaactgccagagttttctctgggtgttaacagcggttggactacagacaattgcttccgggcagcgttccaaaatactggctacagcagtctcatcggcacctagttcttgtaaaatattcgcaatttcttcaacataggtttcatcctctaaaagtacccatccttttaatctacgaattttcctaatgtcaactgaacatttatagagcttttccactgttcttgtattttctttgctcgactgtttatcagttgtataggtgaagcatgctaagaaaggtctgtattttggaggtgatcgcatctttctgaaagaacacagcctgcaggactgggatctcagcagcagcttccacaacatggctgcaatctactagctagtttccaccgtcctgggacttaaatggactcattctatcttacagtctctccccacagatcttgtcctcatccagatattcagttcatccacttgggattctttccaacttcttctcaaaatgtgatcttgtcagttccccgtcggcgtcagctccaagcaaggcacagggagtcccgggggccaggccccgtccttccctctctctccggccagcctccccacagtccgcagtccccgaggcctggagccgggatttcggtcctcggtctcaagaagctcccgaca

SEQ ID NO: 354662 - DNA, 860 bp, Homo sapiens
ggacaagaagcataaactgaaaactccaagcgtttcctatcacacttcaaatgagattctgctccttagatggacctgtgctgcctctttcctcttgtgccactctcccaatcactcaaccctgctccaactgtactggctgctattcttcttgaacaaaccttcctgcatgaccttgggtaagtgacttaccctgagtctcctcatccatagaagagtgaacaatggtactttagaatcgtaaagcacttatatacagagctccctataggaagtgaacagatttggatagtaagggttacttgcatttgctgaaggagtgaagagtgaggatactgcctgcattttccataattttttcattatacttaagccatgtacaaatagtgcacagatgttgtcagtcaattgtttggctgtgcatttgttacaaagttcagacttcacagctgaaagtgagtcagttctttatctgggtatgtttatcttggaacaaggttcagaaatggaaacttgaaacaccacccctaaaattagtactaaccatcacccactttcccttacaggcagacctggatcttcagaaagttttctaaaaagctccatttatttcaaatgtatataaattagataattttgaattagaacactttatagagaggttttcataaatgtccccgaatttgttgttagtacttattccttttggcctgtcaggtaggggtgacttctcttatgccaattcataagtaatccttccagttcacaaggtttaaacagaagtcagagcccagttaataaacccagactctgccatttggcagctgagtggcctctcagcttcagtttcctcatgtgta

SEQ ID NO: 354663 - DNA, 3364 bp, Homo sapiens
ggccggaccctgcgagaacgggtgggcgtgtgcccggtgggcgcgggaggggcccgggctgcacgagcgcgcgtgcgcgtcggaactggagccgcgggaggaggcgggagctgaggaggcggcggagggggcgggtcgcgtcgggcgccacgtccgcagccagaggcctccgcctccaccaccgccgccacagtcttccagctccacatcctgagaggacgcctctggagccgcgactgcccggggttgtgccggccgccgctgccgcccaggccgcctcagctctcctctgcgccggcccgctcactccgcccggccccagccctagcgctggccgcgaccccggcgcctttgaaacttctgctggtgtgagtgccctcaggggttccccaggaatatcgatacaacaccaacaggagatcatgaatcagacagataaaaatcaacaagaaatcccatcataccttaatgatgaaccaccagaaggttcaatgaaagatcacccacagcagcagccaggcatgttgtcccgtgtgactgggggtatcttcagtgttacaaagggagctgttggtgccaccattggtggtgtggcttggattggtggaaagagtctggaagtgaccaaaacagctgttacaactgtgccttccatgggaatagggctggtgaaagggggtgtctctgctgtggctggaggtgttacagctgttgggtctgctgttgtaaacaaagtgcccttaacaggaaagaagaaagacaaatctgactgaaatatagagatacacttgcgctccacagcactgtaatgccagtggcattgaattgctaaattatggactacaaccaagtcaactgttttggacgtttatcttctaaactgctgtgttgaaagtattgatgactggctttcatctaaaaagaagagaccaatacgagcacagtatatgaaggtttctcatacttaagttccaggtttttatctggtaaaatgttacacttactcggttgtaactgaagatatggtatgtttgaatatttactataagtctttcagtttgactaaaaatgtgaaagttgaatttagtagatgatcttcacagttccatatgtataatgtgccaggtaactcacctgccccttaagaagggaaccttgaattacataagccgtacctttgatgtgcctaatagtttcagatgtcttagttttttataaccatagttgattaggccaagaggcattcatttcttatttaagctggcaaaattagcaggaattagagaagtttaaaaagataaatggttttatgataatgttaaccatcttttgttagtaaatatgcgttctattattttaatcattgatgccttacaaaagaaaacatcttttctaataccctgaatatgtgctgttcttagaatcatctatggattcttttaaaggttgtttgtgaaattagttttccctttttagaatctcaggagtagtggggtaaagacatttcctgctgtcagtggataagacagagcttgttaactgttttggcagtagttaaaatcaaattgtacacttctcagcctgggttcatgcttcatcattaatacacctcacagtgcctaaggaacatttacttactggtcagaaggtattttggaagagtttcatattaaggaggaacaaataataattttaagttcttaaaaattacctaaaacaccccaaatataaaaagaagccttcacacctattctgtctttaggatgtcttaaattattagcagtactccttttttaaaaacactgtaaaagtaaccacaaatatgtgaggacttactattttaaatggaatggaatgagctccatagattagttttgaatataaagtatataaaagtgcatcagtggtttatataggctttaaaaacatgttatcttacagtcctttaaagcagccatagagtttgtatcatttttcaagccaatttcagtcagggatttgaattgtttgattatggatgataaatgtgtcatatcttattaatatgtctcatgtctcgttccttcttaatatgatttagctggaattcattttcttttcgtttcatgtttaatttcataaaacgtttaacaattggcatatatacttggcattcctgtccaccaaggattgtaatccaagcctgggaaaatcttaaatttctttttacttaaatctggaaatttgtctccattctgccacctttttttttttttttttttatagtggaggggaggaaaggggggtgataccttgcagtaagtaagtcgaaatagcatgcctgaaaatttgaaacagaccattctaacacccaaggcttgtttataaaatacttgagaattacattaatgtggaatcaacagatgcagaagaatataacataacttttaaaagctttcataaataccagcagcaattgtaagcaaatctacaaaggttcttgaacctttctattatatacaaaactgaaaagtcattaaggagttcaactaatcaggaattaaatggtcatttatttcatgcagtatgatttaaggtatttcttgagattctggtcaaatgtcataatcagcaaacgggattaaaaaaaaaactccaaaatcactaaataattatctaaataatggtattggagaacttgtttcctgctatttggaagagattgttgcttcattgctagtttgtatttctaacttctacagttatagactccactgtgctttgtgtctgaatttctcagtatagacattttgtttactgtatgcttgcatatttattttcaactttgcctgtctttaaaattgcttgaggaaaaatggttgtaattaatttctgctacagaaaagccacctggtacgttttgtctcatcaggattgttttaaattctaaactataagtttgttcagaggggcttttgcaatgatagcagaaaactgtacaaatgtacagttagttatagaggttcttgttgaaatgaacttaccatctgatgatatgtatgtacagctgtgtacttgagtcttttttagtttacttagaaagactagcagtttgacctgttaaacaggactagttcaagtcaagaaactaaggttgttgtatacacctggaggcatctgttattcagcttatcctttgagtgggtatttggcacaatgaggataaacttatgtgacccacttgaatggctgatctaataatgttgacattatgcattctgtacttagtgaaatgtcagatgaaaataactgatgaataatttttttgtattaaagggatgggaaaagaacacatgaatttgttaataaagcactatgatctgca

SEQ ID NO: 354664 - DNA, 3419 bp, Homo sapiens
ggccggaccctgcgagaacgggtgggcgtgtgcccggtgggcgcgggaggggcccgggctgcacgagcgcgcgtgcgcgtcggaactggagccgcgggaggaggcgggagctgaggaggcggcggagggggcgggtcgcgtcgggcgccacgtccgcagccagaggcctccgcctccaccaccgccgccacagtcttccagctccacatcctgagaggacgcctctggagccgcgactgcccggggttgtgccggccgccgctgccgcccaggccgcctcagctctcctctgcgccggcccgctcactccgcccggccccagccctagcgctggccgcgaccccggcgcctttgaaacttctgctggtgtgagtgccctcaggggttccccaggaatatcgatacaacaccaacaggagatcatgaatcagacagataaaaatcaacaagaaatcccatcataccttaatgatgaaccaccagaaggttcaatgaaagatcacccacagcagcagccaggcatgttgtcccgtgtgactgggggtatcttcagtgttacaaagggagctgttggtgccaccattggtggtgtggcttggattggtggaaagagtctggaagtgaccaaaacagctgttacaactgtgccttccatgggaatagggctggtgaaagggggtgtctctgctgtggctggaggtgttacagctgttgggtctgctgttgtaaacaaagtgcccttaacaggaaagaagaaagacaaatctgactgaaatatagagatacacttgcgctccacagcactgtaatgccagtggcattgaattgctaaattatggactacaaccaagtcaactgttttggacgtttatcttctaaactgctgtgttgaaagtattgatgactggctttcatctaaaaagaagagaccaatacgagcacagtatatgaaggtttctcatacttaagttccaggtttttatctggtaaaatgttacacttactcggttgtaactgaagatatggtatgtttgaatatttactataagtctttcagtttgactaaaaatgtgaaagttgaatttagtagatgatcttcacagttccatatgtataatgtgccaggtaactcacctgccccttaagaagggaaccttgaattacataagccgtacctttgatgtgcctaatagtttcagatgtcttagttttttataaccatagttgattaggccaagaggcattcatttcttatttaagctggcaaaattagcaggaattagagaagtttaaaaagataaatggttttatgataatgttaaccatcttttgttagtaaatatgcgttctattattttaatcattgatgccttacaaaagaaaacatcttttctaataccctgaatatgtgctgttcttagaatcatctatggattcttttaaaggttgtttgtgaaattagttttccctttttagaatctcaggagtagtggggtaaagacatttcctgctgtcagtggataagacagagcttgttaactgttttggcagtagttaaaatcaaattgtacacttctcagcctgggttcatgcttcatcattaatacacctcacagtgcctaaggaacatttacttactggtcagaaggtattttggaagagtttcatattaaggaggaacaaataataattttaagttcttaaaaattacctaaaacaccccaaatataaaaagaagccttcacacctattctgtctttaggatgtcttaaattattagcagtactccttttttaaaaacactgtaaaagtaaccacaaatatgtgaggacttactattttaaatggaatggaatgagctccatagattagttttgaatataaagtatataaaagtgcatcagtggtttatataggctttaaaaacatgttatcttacagtcctttaaagcagccatagagtttgtatcatttttcaagccaatttcagtcagggatttgaattgtttgattatggatgataaatgtgtcatatcttattaatatgtctcatgtctcgttccttcttaatatgatttagctggaattcattttcttttcgtttcatgtttaatttcataaaacgtttaacaattggcatatatacttggcattcctgtccaccaaggattgtaatccaagcctgggaaaatcttaaatttctttttacttaaatctggaaatttgtctccattctgccacctttttttttttttttttttatagtggaggggaggaaaggggggtgataccttgcagtaagtaagtcgaaatagcatgcctgaaaatttgaaacagaccattctaacacccaaggcttgtttataaaatacttgagaattacattaatgtggaatcaacagatgcagaagaatataacataacttttaaaagctttcataaataccagcagcaattgtaagcaaatctacaaaggttcttgaacctttctattatatacaaaactgaaaagtcattaaggagttcaactaatcaggaattaaatggtcatttatttcatgcagtatgatttaaggtatttcttgagattctggtcaaatgtcataatcagcaaacgggattaaaaaaaaaactccaaaatcactaaataattatctaaataatggtattggagaacttgtttcctgctatttggaagagattgttgcttcattgctagtttgtatttctaacttctacagttatagactccactgtgctttgtgtctgaatttctcagtatagacattttgtttactgtatgcttgcatatttattttcaactttgcctgtctttaaaattgcttgaggaaaaatggttgtaattaatttctgctacagaaaagccacctggtacgttttgtctcatcaggattgttttaaattctaaactataagtttgttcagaggggcttttgcaatgatagcagaaaactgtacaaatgtacagttagttatagaggttcttgttgaaatgaacttaccatctgatgatatgtatgtacagctgtgtacttgagtcttttttagtttacttagaaagactagcagtttgacctgttaaacaggactagttcaagtcaagaaactaaggttgttgtatacacctggaggcatctgttattcagcttatcctttgagtgggtatttggcacaatgaggataaacttatgtgacccacttgaatggctgatctaataatgttgacattatgcattctgtacttagtgaaatgtcagatgaaaataactgatgaataatttttttgtattaaagggatgggaaaagaacacatgaatttgttaataaagcactatgatctgcaaacgatggaatgtttcataaagatctaaagaaataaaggaaactttaaaacagag

SEQ ID NO: 354665 - DNA, 3130 bp, Homo sapiens
gctaattccaaatgaaaatatttgctatatgtgattatttgctgtatgctattgtttagcctttgaaacttctgctggtgtgagtgccctcaggggttccccaggaatatcgatacaacaccaacaggagatcatgaatcagacagataaaaatcaacaagaaatcccatcataccttaatgatgaaccaccagaaggttcaatgaaagatcacccacagcagcagccaggcatgttgtcccgtgtgactgggggtatcttcagtgttacaaagggagctgttggtgccaccattggtggtgtggcttggattggtggaaagagtctggaagtgaccaaaacagctgttacaactgtgccttccatgggaatagggctggtgaaagggggtgtctctgctgtggctggaggtgttacagctgttgggtctgctgttgtaaacaaagtgcccttaacaggaaagaagaaagacaaatctgactgaaatatagagatacacttgcgctccacagcactgtaatgccagtggcattgaattgctaaattatggactacaaccaagtcaactgttttggacgtttatcttctaaactgctgtgttgaaagtattgatgactggctttcatctaaaaagaagagaccaatacgagcacagtatatgaaggtttctcatacttaagttccaggtttttatctggtaaaatgttacacttactcggttgtaactgaagatatggtatgtttgaatatttactataagtctttcagtttgactaaaaatgtgaaagttgaatttagtagatgatcttcacagttccatatgtataatgtgccaggtaactcacctgccccttaagaagggaaccttgaattacataagccgtacctttgatgtgcctaatagtttcagatgtcttagttttttataaccatagttgattaggccaagaggcattcatttcttatttaagctggcaaaattagcaggaattagagaagtttaaaaagataaatggttttatgataatgttaaccatcttttgttagtaaatatgcgttctattattttaatcattgatgccttacaaaagaaaacatcttttctaataccctgaatatgtgctgttcttagaatcatctatggattcttttaaaggttgtttgtgaaattagttttccctttttagaatctcaggagtagtggggtaaagacatttcctgctgtcagtggataagacagagcttgttaactgttttggcagtagttaaaatcaaattgtacacttctcagcctgggttcatgcttcatcattaatacacctcacagtgcctaaggaacatttacttactggtcagaaggtattttggaagagtttcatattaaggaggaacaaataataattttaagttcttaaaaattacctaaaacaccccaaatataaaaagaagccttcacacctattctgtctttaggatgtcttaaattattagcagtactccttttttaaaaacactgtaaaagtaaccacaaatatgtgaggacttactattttaaatggaatggaatgagctccatagattagttttgaatataaagtatataaaagtgcatcagtggtttatataggctttaaaaacatgttatcttacagtcctttaaagcagccatagagtttgtatcatttttcaagccaatttcagtcagggatttgaattgtttgattatggatgataaatgtgtcatatcttattaatatgtctcatgtctcgttccttcttaatatgatttagctggaattcattttcttttcgtttcatgtttaatttcataaaacgtttaacaattggcatatatacttggcattcctgtccaccaaggattgtaatccaagcctgggaaaatcttaaatttctttttacttaaatctggaaatttgtctccattctgccacctttttttttttttttttttatagtggaggggaggaaaggggggtgataccttgcagtaagtaagtcgaaatagcatgcctgaaaatttgaaacagaccattctaacacccaaggcttgtttataaaatacttgagaattacattaatgtggaatcaacagatgcagaagaatataacataacttttaaaagctttcataaataccagcagcaattgtaagcaaatctacaaaggttcttgaacctttctattatatacaaaactgaaaagtcattaaggagttcaactaatcaggaattaaatggtcatttatttcatgcagtatgatttaaggtatttcttgagattctggtcaaatgtcataatcagcaaacgggattaaaaaaaaaactccaaaatcactaaataattatctaaataatggtattggagaacttgtttcctgctatttggaagagattgttgcttcattgctagtttgtatttctaacttctacagttatagactccactgtgctttgtgtctgaatttctcagtatagacattttgtttactgtatgcttgcatatttattttcaactttgcctgtctttaaaattgcttgaggaaaaatggttgtaattaatttctgctacagaaaagccacctggtacgttttgtctcatcaggattgttttaaattctaaactataagtttgttcagaggggcttttgcaatgatagcagaaaactgtacaaatgtacagttagttatagaggttcttgttgaaatgaacttaccatctgatgatatgtatgtacagctgtgtacttgagtcttttttagtttacttagaaagactagcagtttgacctgttaaacaggactagttcaagtcaagaaactaaggttgttgtatacacctggaggcatctgttattcagcttatcctttgagtgggtatttggcacaatgaggataaacttatgtgacccacttgaatggctgatctaataatgttgacattatgcattctgtacttagtgaaatgtcagatgaaaataactgatgaataatttttttgtattaaagggatgggaaaagaacacatgaatttgttaataaagcactatgatctgcaaacgatggaatgtttcataaagatctaaagaaataaaggaaactttaaaacagag

SEQ ID NO: 354666 - DNA, 1782 bp, Homo sapiens
ggccggaccctgcgagaacgggtgggcgtgtgcccggtgggcgcgggaggggcccgggctgcacgagcgcgcgtgcgcgtcggaactggagccgcgggaggaggcgggagctgaggaggcggcggagggggcgggtcgcgtcgggcgccacgtccgcagccagaggcctccgcctccaccaccgccgccacagtcttccagctccacatcctgagaggacgcctctggagccgcgactgcccggggttgtgccggccgccgctgccgcccaggccgcctcagctctcctctgcgccggcccgctcactccgcccggccccagccctagcgctggccgcgaccccggcgcctttgaaacttctgctggtgtgagtgccctcaggggttccccaggaatatcgatacaacaccaacaggagatcatgaatcagacagataaaaatcaacaagaaatcccatcataccttaatgatgaaccaccagaaggttcaatgaaagatcacccacagcagcagccaggcatgttgtcccgtgtgactgggggtatcttcagtgttacaaagggagctgttggtgccaccattggtggtgtggcttggattggtggaaagagtctggaagtgaccaaaacagctgttacaactgtgccttccatgggaatagggctggtgaaagggggtgtctctgctgtggctggaggtgttacagctgttgggtctgctgttgtaaacaaagtgcccttaacaggaaagaagaaagacaaatctgactgaaatatagagatacacttgcgctccacagcactgtaatgccagtggcattgaattgctaaattatggactacaaccaagtcaactgttttggacgtttatcttctaaactgctgtgttgaaagtattgatgactggctttcatctaaaaagaagagaccaatacgagcacagtatatgaaggtttctcatacttaagttccaggtttttatctggtaaaatgttacacttactcggttgtaactgaagatatggaagatctgagttagaatgtatgaatggaaaaaaaaggcaaagcagaacaatttcagaggttcaagagccaaaagcaatggaatggaccctaagggaaaataaaatggacctgtgctgcctctttcctcttgtgccactctcccaatcactcaaccctgctccaactgtactggctgctattcttcttgaacaaaccttcctgcatgaccttggaccaactgccagagttttctctgggtgttaacagcggttggactacagacaattgcttccgggcagcgttccaaaatactggctacagcagtctcatcggcacctagttcttgtaaaatattcgcaatttcttcaacataggtttcatcctctaaaagtacccatccttttaatctacgaattttcctaatgtcaactgaacatttatagagcttttccactgttcttgtattttctttgctcgactgtttatcagttgtataggtgaagcatgctaagaaaggtctgtattttggaggtgatcgcatctttctgaaagaacacagcctgcaggactgggatctcagcagcagcttccacaacatggctgcaatctactagctagtttccaccgtcctgggacttaaatggactcattctatctgaaaaaaagaaaataaaggtttttagtataagggtgttgactttcagaacacatacacttacaaatttgagctgttgaagtctggaaataaagtggatttaaattagacaagaaaactg

SEQ ID NO: 354667 - DNA, 320 bp, Homo sapiens
tatggagaaaagccaggggagtacacttctgtgactgtctgtgttgagctcatttaattgcaggggagaaggaagcacaatatttttgttctagtcacccaatcatcagttcatttattcacttaatacttattaagcaactacagatgcaaagggagaattggaatctgcagtcaacatttgaacaacacaggtttgaacagcaagtgtccacttataggtggatttctttcaaccaataccgatcaagaatacagtatctgagagtccaaagcctgcatgtagggagggttgactttctgtatacaaggcttccacag

SEQ ID NO: 354668 - DNA, 456 bp, Homo sapiens
gatgccaagacaggaggattgcttgatgccaagacaggaggattgcttgaggccaagtattcaagaccagcctgggcaacacagacattgcaacatccctgtctttaccaaaaaggaaaaaattagccagccatggtggcatgcacctatgggcctagttactcaagaggctgacgtgggaagatagcttgagcccaggagttcaaggttacagtgtccagcctgggtgacagaataagaccacgtctcaaaaaacaaagaaacaaacaaaccagcctgggacctcctccctgctttgcttcctcttcagcatgtgtgatctctttgcacatgccgattcccctttcacattccaccttgagctgaagcagcctgagaccctcaccagaggcccaatcttgaactttccagccaccagaattgcaagctaaataaacctcttttcttcataaacta

SEQ ID NO: 354669 - DNA, 2986 bp, Homo sapiens
  misc_feature (6)..(7): n is a, c, g, or t
  misc_feature (9)..(9): n is a, c, g, or t
ggcacnngncccttgcgcctccttgcccggccgcgcccagcccggcgtcccgagcagcgcaggggaggatccccgcgcagtgacccgggagccaccacagactctgggaggctcggcggctggagcagcaggcagctccccgcagctcccggcgcttccaggcagctctctgagccgtgccagaggcccggcccgccattcccagccccgagccatgatgaagactttgtccagcgggaactgcacgctcagtgtgcccgccaaaaactcataccgcatggtggtgctgggtgcctctcgggtgggcaagagctccatcgtgtctcgcttcctcaatggccgctttgaggaccagtacacacccaccatcgaggacttccaccgtaaggtatacaacatccgcggcgacatgtaccagctcgacatcctggatacctctggcaaccaccccttccccgccatgcgcaggctgtccatcctcacaggggatgtcttcatcctggtgttcagcctggataaccgggagtccttcgatgaggtcaagcgccttcagaagcagatcctggaggtcaagtcctgcctgaagaacaagaccaaggaggcggcggagctgcccatggtcatctgtggcaacaagaacgaccacggcgagctgtgccgccaggtgcccaccaccgaggccgagctgctggtgtcgggcgacgagaactgcgcctacttcgaggtgtcggccaagaagaacaccaacgtggacgagatgttctacgtgctcttcagcatggccaagctgccacacgagatgagccccgccctgcatcgcaagatctccgtgcagtacggtgacgccttccaccccaggcccttctgcatgcgccgcgtcaaggagatggacgcctatggcatggtctcgcccttcgcccgccgccccagcgtcaacagtgacctcaagtacatcaaggccaaggtccttcgggaaggccaggcccgtgagagggacaagtgcaccatccagtgagcgagggatgctggggcggggcttggccagtgccttcagggaggtggccccagatgcccactgtgcgcatctccccaccgaggccccggcagcagtcttgttcacagaccttaggcaccagactggaggcccccgggcgctggcctccgcacattcgtctgccttctcacagctttcctgagtccgcttgtccacagctccttggtggtttcatctcctctgtgggaggacacatctctgcagcctcaagagttaggcagagactcaagttacaccttcctctcctggggttggaagaaatgttgatgccagaggggtgaggattgctgcgtcatatggagcctcctgggacaagcctcaggatgaaaaggacacagaaggccagatgagaaaggtctcctctctcctggcataacacccagcttggtttgggtggcagctgggagaacttctctcccagccctgcaactcttacgctctggttcagctgcctctgcaccccctcccacccccagcacacacacaagttggcccccagctgcgcctgacattgagccagtggactctgtgtctgaagggggcgtggccacacctcctagaccacgcccaccacttagaccacgcccacctcctgaccgcgttcctcagcctcctctcctaggtccctccgcccgacagttgtgctttgttgtggttgcagctgttttcgtgtcatgtatagtagtagaaatggaaatcattgtactgtaaaagcctagtgactccctccttggccaggccctcacccagttcagatccacggcctccacccgggacgccttcctcctctgctcccaaacagggtttccgtggcctgtttgcagctagacattgacctccgccattgagctccacggtttacagacaattgcacaagcgtggggtgggcaggccaggactgcttttttttaatgctcccatttcacagaggataccaccgagactcggaggggacacgatgagcaccaggccccacctttgtcccctagcaaattcagggtacagctccacctagaaccaggctgccctctactgtgctcgttcctcaagcatttattaagcacctactgggtgctgggttcactgtgtcctaggaaaccaagagggtccccagtcctggcctctgcccgcccctgctgccccaccaccttctgcacacacagcggtggggaggcggggaggagcagctgggacccagaactgagcctgggagggatccgacagaaaagctcagggcgggtcttctccttgtgcccgggattgggctatgctgggtaccaccatgtactcaggcatggtgggttttgaacccataaaccaaaggcccttgtcatcagctcttaacaagtatattttgtattttaatctctctaaacatattgaagttttagggccctaaggaaccttagtgatcttctattgggtctttctgaggttcagagagggtaagtaacttcctccaggtcacacagcaagtctgtgggtggcagaagcaagctagcgctgggcattcagtacataccacgatgtgctccctctcttgatgcttggcccctggggccttcagggctttgggacatcttgtcctcaaccctctccctagatcagtctgtgagggtccctgtagatattgtgtacaccatgcccatgtatatacaagtacacacagatgtacacacagatgtacacatgctccagccccagctctgcatacctgcacctgcaccccagccttggcccctgcctgcgtctgtgctcaaagcagcagctccaaccctgcctctgtccccttccccacccactgcctgagccttctgagcagaccaggtaccttggctgcaccggtgtgtggcccgctctcacccaggcacagccccgccaccatggatctccgtgtacactatcaataaaagtgggtttgttacaaaaaaa

SEQ ID NO: 354670 - DNA, 2808 bp, Homo sapiens
atgcctgcttctctcgctttgttgcagccccgagccatgatgaagactttgtccagcgggaactgcacgctcagtgtgcccgccaaaaactcataccgcatggtggtgctgggtgcctctcgggtgggcaagagctccatcgtgtctcgcttcctcaatggccgctttgaggaccagtacacacccaccatcgaggacttccaccgtaaggtatacaacatccgcggcgacatgtaccagctcgacatcctggatacctctggcaaccaccccttccccgccatgcgcaggctgtccatcctcacaggggatgtcttcatcctggtgttcagcctggataaccgggagtccttcgatgaggtcaagcgccttcagaagcagatcctggaggtcaagtcctgcctgaagaacaagaccaaggaggcggcggagctgcccatggtcatctgtggcaacaagaacgaccacggcgagctgtgccgccaggtgcccaccaccgaggccgagctgctggtgtcgggcgacgagaactgcgcctacttcgaggtgtcggccaagaagaacaccaacgtggacgagatgttctacgtgctcttcagcatggccaagctgccacacgagatgagccccgccctgcatcgcaagatctccgtgcagtacggtgacgccttccaccccaggcccttctgcatgcgccgcgtcaaggagatggacgcctatggcatggtctcgcccttcgcccgccgccccagcgtcaacagtgacctcaagtacatcaaggccaaggtccttcgggaaggccaggcccgtgagagggacaagtgcaccatccagtgagcgagggatgctggggcggggcttggccagtgccttcagggaggtggccccagatgcccactgtgcgcatctccccaccgaggccccggcagcagtcttgttcacagaccttaggcaccagactggaggcccccgggcgctggcctccgcacattcgtctgccttctcacagctttcctgagtccgcttgtccacagctccttggtggtttcatctcctctgtgggaggacacatctctgcagcctcaagagttaggcagagactcaagttacaccttcctctcctggggttggaagaaatgttgatgccagaggggtgaggattgctgcgtcatatggagcctcctgggacaagcctcaggatgaaaaggacacagaaggccagatgagaaaggtctcctctctcctggcataacacccagcttggtttgggtggcagctgggagaacttctctcccagccctgcaactcttacgctctggttcagctgcctctgcaccccctcccacccccagcacacacacaagttggcccccagctgcgcctgacattgagccagtggactctgtgtctgaagggggcgtggccacacctcctagaccacgcccaccacttagaccacgcccacctcctgaccgcgttcctcagcctcctctcctaggtccctccgcccgacagttgtgctttgttgtggttgcagctgttttcgtgtcatgtatagtagtagaaatggaaatcattgtactgtaaaagcctagtgactccctccttggccaggccctcacccagttcagatccacggcctccacccgggacgccttcctcctctgctcccaaacagggtttccgtggcctgtttgcagctagacattgacctccgccattgagctccacggtttacagacaattgcacaagcgtggggtgggcaggccaggactgcttttttttaatgctcccatttcacagaggataccaccgagactcggaggggacacgatgagcaccaggccccacctttgtcccctagcaaattcagggtacagctccacctagaaccaggctgccctctactgtgctcgttcctcaagcatttattaagcacctactgggtgctgggttcactgtgtcctaggaaaccaagagggtccccagtcctggcctctgcccgcccctgctgccccaccaccttctgcacacacagcggtggggaggcggggaggagcagctgggacccagaactgagcctgggagggatccgacagaaaagctcagggcgggtcttctccttgtgcccgggattgggctatgctgggtaccaccatgtactcaggcatggtgggttttgaacccataaaccaaaggcccttgtcatcagctcttaacaagtatattttgtattttaatctctctaaacatattgaagttttagggccctaaggaaccttagtgatcttctattgggtctttctgaggttcagagagggtaagtaacttcctccaggtcacacagcaagtctgtgggtggcagaagcaagctagcgctgggcattcagtacataccacgatgtgctccctctcttgatgcttggcccctggggccttcagggctttgggacatcttgtcctcaaccctctccctagatcagtctgtgagggtccctgtagatattgtgtacaccatgcccatgtatatacaagtacacacagatgtacacacagatgtacacatgctccagccccagctctgcatacctgcacctgcaccccagccttggcccctgcctgcgtctgtgctcaaagcagcagctccaaccctgcctctgtccccttccccacccactgcctgagccttctgagcagaccaggtaccttggctgcaccggtgtgtggcccgctctcacccaggcacagccccgccaccatggatctccgtgtacactatcaataaaagtgggtttgttacaaaaaaa

SEQ ID NO: 354671 - DNA, 472 bp, Homo sapiens
  misc_feature (15)..(15): n is a, c, g, or t
  misc_feature (54)..(54): n is a, c, g, or t
  misc_feature (64)..(64): n is a, c, g, or t
  misc_feature (134)..(134): n is a, c, g, or t
  misc_feature (139)..(139): n is a, c, g, or t
  misc_feature (162)..(162): n is a, c, g, or t
  misc_feature (194)..(194): n is a, c, g, or t
ctatacatttgtgtncttcccagtagggcccatctcaagttgaatagtgcaggntggcccaggnctgcttccaggacttgcctgtcctccctgagtttggatgggagagacacaagggcctggacctcagtttnctgtnctctgccccagctcagtgcaccngtgcaacaactccatccagaagcacctggagnactcatgccatcggcatccactgcttccgccagaaccacaaatatcgggttctggcgtggccacacctcctagaccacgcccaccacttagaccacgcccacctcctgaccgcgttcctcagcctcctctcctaggtccctccgcccgacagttgtgctttgttgtggttgcagctgttttcgtgtcatgtatagtagtagaaatggaaatcattgtactgtaaaagcctagtgactccctccttggccagaaccacaaatatcgggggatcctctag

SEQ ID NO: 354672 - DNA, 969 bp, Homo sapiens
ttccttttttcccggcgtgcaccgcgaatccctcctcctcttctttacctctctccctcctcctcaggttctctatcgacgagtctggtagctgagcgttgggctgtaggtcgctgtgctgtgtgatcccccagagccatgcccgagatagtggatacctgttcgttggcctctccggcttccgtctgccggaccaagcacctgcacctgcgctgcagcgtcgactttactcgccggacgctgaccgggactgctgctctcacggtccagtctcaggaggacaatctgcgcagcctggttttggatacaaaggaccttacaatagaaaaagtagtgatcaatggacaagaagtcaaatatgctcttggagaaagacaaagttacaagggatcgccaatggaaatctctcttcctatcgctttgagcaaaaatcaagaaattgttatagaaatttcttttgagacctctccaaaatcttctgctctccagtggctcactcctgaacagacttctgggaaggaacacccatatctctttagtcagtgccaggccatccactgcagagcaatccttccttgtcaggacactccttctgtgaaattaacctatactgcagaggtgtctgtccctaaagaactggtggcacttatgagtgctattcgtgatggagaaacacctgacccagaagacccaagcaggaaaatatacaaattcatccaaaaagtcaataacctggtactgatgttagttgtgggcttagaagggggaattggcagacttgtgtggctgaaaggagggaaagttgtatagtttggagattatgtaaaacgaactggagccgtttgggagatgcatggtgcaactctatggggggactggtgaccacagggcgaaaccaggcggagattacgggaggcagggcgttgatgtcgcgagggaagggagaagtgatgttgtttttgttttcgt

SEQ ID NO: 354673 - DNA, 359 bp, Homo sapiens
aaattaaaaatgactgagcagagatgtaataaagattcagctcaatccagcacacatttattgtcaggcactaatatgatgaataaggaactcacagagcaaatatgtatgtatcaagtaattataatacaatgaaaagtattttttttaaaatattaagtgttgtgggtgaggaaactattaattttaatggtgatggatttggacatcgtcttggagatgacttacaaaggagaatacaagaagtaaactgtagaaccttagaggatcttcattttagagctaggacagaggaaaggtagcaaaataaatggaaaactaaaaagatttcaaaggttcattgttaagaaagctgtggg

SEQ ID NO: 354674 - DNA, 2079 bp, Homo sapiens
ttccttttttcccggcgtgcaccgcgaatccctcctcctcttctttacctctctccctcctcctcaggttctctatcgacgagtctggtagctgagcgttgggctgtaggtcgctgtgctgtgtgatcccccagagccatgcccgagatagtggatacctgttcgttggcctctccggcttccgtctgccggaccaagcacctgcacctgcgctgcagcgtcgactttactcgccggacgctgaccgggactgctgctctcacggtccagtctcaggaggacaatctgcgcagcctggttttggatacaaaggaccttacaatagaaaaagtagtgatcaatggacaagaagtcaaatatgctcttggagaaagacaaagttacaagggatcgccaatggaaatctctcttcctatcgctttgagcaaaaatcaagaaattgttatagaaatttcttttgagacctctccaaaatcttctgctctccagtggctcactcctgaacagacttctgggaaggaacacccatatctctttagtcagtgccaggccatccactgcagagcaatccttccttgtcaggacactccttctgtgaaattaacctatactgcagaggtgtctgtccctaaagaactggtggcacttatgagtgctattcgtgatggagaaacacctgacccagaagacccaagcaggaaaatatacaaattcatccaaaaagttccaataccctgctacctgattgctttagttgttggagctttagaaagcaggcaaattggcccaagaactttggtgtggtctgagaaagagcaggtggaaaagtctgcttatgagttttctgagactgaatctatgcttaaaatagcagaagatctgggaggaccgtatgtatggggacagtatgacctattggtcctgccaccatccttcccttatggtggcatggagaatccttgccttacttttgtaactcctactctactggcaggcgacaagtcactctccaatgtcattgcacatgaaatatctcatagctggacagggaatctagtgaccaacaaaacttgggatcacttttggttaaatgagggacatactgtgtacttggaacgccacatttgcggacgattgtttggtgtaaagacatttggggagacacatcctttcaccaaacttgtggttgatctgacagatatagaccctgatgtagcttattcttcagttccctatgagaagggctttgctttacttttttaccttgaacaactgcttggaggaccagagattttcctaggattcttaaaagcttatgttgagaagttttcctataagagcataactactgatgactggaaggatttcctgtattcctattttaaagataaggttgatgttctcaatcaagttgattggaatgcctggctctactctcctggactgcctcccataaagcccaattatgatatgactctgacaaatgcttgtattgccttaagtcaaagatggattactgccaaagaagatgatttaaattcattcaatgccacagacctgaaggatctctcttctcatcaattgaatgagtttttagcacagacgctccagagggcacctcttccattggggcacataaagcgaatgcaagaggtgtacaacttcaatgccattaacaattctgaaatacgattcagatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttctta

SEQ ID NO: 354675 - DNA, 2091 bp, Homo sapiens
ttccttttttcccggcgtgcaccgcgaatccctcctcctcttctttacctctctccctcctcctcaggttctctatcgacgagtctggtagctgagcgttgggctgtaggtcgctgtgctgtgtgatcccccagagccatgcccgagatagtggatacctgttcgttggcctctccggcttccgtctgccggaccaagcacctgcacctgcgctgcagcgtcgactttactcgccggacgctgaccgggactgctgctctcacggtccagtctcaggaggacaatctgcgcagcctggttttggatacaaaggaccttacaatagaaaaagtagtgatcaatggacaagaagtcaaatatgctcttggagaaagacaaagttacaagggatcgccaatggaaatctctcttcctatcgctttgagcaaaaatcaagaaattgttatagaaatttcttttgagacctctccaaaatcttctgctctccagtggctcactcctgaacagacttctgggaaggaacacccatatctctttagtcagtgccaggccatccactgcagagcaatccttccttgtcaggacactccttctgtgaaattaacctatactgcagaggtgtctgtccctaaagaactggtggcacttatgagtgctattcgtgatggagaaacacctgacccagaagacccaagcaggaaaatatacaaattcatccaaaaagttccaataccctgctacctgattgctttagttgttggagctttagaaagcaggcaaattggcccaagaactttggtgtggtctgagaaagagcaggtggaaaagtctgcttatgagttttctgagactgaatctatgcttaaaatagcagaagatctgggaggaccgtatgtatggggacagtatgacctattggtcctgccaccatccttcccttatggtggcatggagaatccttgccttacttttgtaactcctactctactggcaggcgacaagtcactctccaatgtcattgcacatgaaatatctcatagctggacagggaatctagtgaccaacaaaacttgggatcacttttggttaaatgagggacatactgtgtacttggaacgccacatttgcggacgattgtttggtgaaaagttcagacattttaatgctctgggaggatggggagaactacagaattcggtaaagacatttggggagacacatcctttcaccaaacttgtggttgatctgacagatatagaccctgatgtagcttattcttcagttccctatgagaagggctttgctttacttttttaccttgaacaactgcttggaggaccagagattttcctaggattcttaaaagcttatgttgagaagttttcctataagagcataactactgatgactggaaggatttcctgtattcctattttaaagataagtctcctggactgcctcccataaagcccaattatgatatgactctgacaaatgcttgtattgccttaagtcaaagatggattactgccaaagaagatgatttaaattcattcaatgccacagacctgaaggatctctcttctcatcaattgaatgagtttttagcacagacgctccagagggcacctcttccattggggcacataaagcgaatgcaagaggtgtacaacttcaatgccattaacaattctgaaatacgattcagatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttctta

SEQ ID NO: 354676 - DNA, 2171 bp, Homo sapiens
ttccttttttcccggcgtgcaccgcgaatccctcctcctcttctttacctctctccctcctcctcaggttctctatcgacgagtctggtagctgagcgttgggctgtaggtcgctgtgctgtgtgatcccccagagccatgcccgagatagtggatacctgttcgttggcctctccggcttccgtctgccggaccaagcacctgcacctgcgctgcagcgtcgactttactcgccggacgctgaccgggactgctgctctcacggtccagtctcaggaggacaatctgcgcagcctggttttggatacaaaggaccttacaatagaaaaagtagtgatcaatggacaagaagtcaaatatgctcttggagaaagacaaagttacaagggatcgccaatggaaatctctcttcctatcgctttgagcaaaaatcaagaaattgttatagaaatttcttttgagacctctccaaaatcttctgctctccagtggctcactcctgaacagacttctgggaaggaacacccatatctctttagtcagtgccaggccatccactgcagagcaatccttccttgtcaggacactccttctgtgaaattaacctatactgcagaggtgtctgtccctaaagaactggtggcacttatgagtgctattcgtgatggagaaacacctgacccagaagacccaagcaggaaaatatacaaattcatccaaaaagttccaataccctgctacctgattgctttagttgttggagctttagaaagcaggcaaattggcccaagaactttggtgtggtctgagaaagagcaggtggaaaagtctgcttatgagttttctgagactgaatctatgcttaaaatagcagaagatctgggaggaccgtatgtatggggacagtatgacctattggtcctgccaccatccttcccttatggtggcatggagaatccttgccttacttttgtaactcctactctactggcaggcgacaagtcactctccaatgtcattgcacatgaaatatctcatagctggacagggaatctagtgaccaacaaaacttgggatcacttttggttaaatgagggacatactgtgtacttggaacgccacatttgcggacgattgtttggtgaaaagttcagacattttaatgctctgggaggatggggagaactacagaattcggtaaagacatttggggagacacatcctttcaccaaacttgtggttgatctgacagatatagaccctgatgtagcttattcttcagttccctatgagaagggctttgctttacttttttaccttgaacaactgcttggaggaccagagattttcctaggattcttaaaagcttatgttgagaagttttcctataagagcataactactgatgactggaaggatttcctgtattcctattttaaagataaggttgatgttctcaatcaagttgattggaatgcctggctctactctcctggactgcctcccataaagcccaattatgatatgactctgacaaatgcttgtattgccttaagtcaaagatggattactgccaaagaagatgatttaaattcattcaatgccacagacctgaaggatctctcttctcatcaattgaatgagtttttagcacagacgctccagagggcacctcttccattggggcacataaagcgaatgcaagaggtgtacaacttcaatgccattaacaattctgaaatacgattcagatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttcttaaaaaaaaaaaaaggggggcggcctaaaatacctcacag

SEQ ID NO: 354677 - DNA, 2210 bp, Homo sapiens
ttccttttttcccggcgtgcaccgcgaatccctcctcctcttctttacctctctccctcctcctcaggttctctatcgacgagtctggtagctgagcgttgggctgtaggtcgctgtgctgtgtgatcccccagagccatgcccgagatagtggatacctgttcgttggcctctccggcttccgtctgccggaccaagcacctgcacctgcgctgcagcgtcgactttactcgccggacgctgaccgggactgctgctctcacggtccagtctcaggaggacaatctgcgcagcctggttttggatacaaaggaccttacaatagaaaaagtagtgatcaatggacaagaagtcaaatatgctcttggagaaagacaaagttacaagggatcgccaatggaaatctctcttcctatcgctttgagcaaaaatcaagaaattgttatagaaatttcttttgagacctctccaaaatcttctgctctccagtggctcactcctgaacagacttctgggaaggaacacccatatctctttagtcagtgccaggccatccactgcagagcaatccttccttgtcaggacactccttctgtgaaattaacctatactgcagaggtgtctgtccctaaagaactggtggcacttatgagtgctattcgtgatggagaaacacctgacccagaagacccaagcaggaaaatatacaaattcatccaaaaagttccaataccctgctacctgattgctttagttgttggagctttagaaagcaggcaaattggcccaagaactttggtgtggtctgagaaagagcaggtggaaaagtctgcttatgagttttctgagactgaatctatgcttaaaatagcagaagatctgggaggaccgtatgtatggggacagtatgacctattggtcctgccaccatccttcccttatggtggcatggagaatccttgccttacttttgtaactcctactctactggcaggcgacaagtcactctccaatgtcattgcacatgaaatatctcatagctggacagggaatctagtgaccaacaaaacttgggatcacttttggttaaatgagggacatactgtgtacttggaacgccacatttgcggacgattgtttggtgaaaagttcagacattttaatgctctgggaggatggggagaactacagaattcggtaaagacatttggggagacacatcctttcaccaaacttgtggttgatctgacagatatagaccctgatgtagcttattcttcagttccctatgagaagggctttgctttacttttttaccttgaacaactgcttggaggaccagagattttcctaggattcttaaaagcttatgttgagaagttttcctataagagcataactactgatgactggaaggatttcctgtattcctattttaaagataaggttgatgttctcaatcaagttgattggaatgcctggctctactctcctggactgcctcccataaagcccaattatgatatgactctgacaaatgcttgtattgccttaagtcaaagatggattactgccaaagaagatgatttaaattcattcaatgccacagacctgaaggatctctcttctcatcaattgaatgagtttttagcacagacgctccagagggcacctcttccattggggcacataaagcgaatgcaagaggtgtacaacttcaatgccattaacaattctgaaatacgattcagatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttcttatagtggcatattctttgtaaattttaacaaggtttaatcttttgatttacaaattaaaaaattttgaattagcttta

SEQ ID NO: 354678 - DNA, 2050 bp, Homo sapiens
ttccttttttcccggcgtgcaccgcgaatccctcctcctcttctttacctctctccctcctcctcaggttctctatcgacgagtctggtagctgagcgttgggctgtaggtcgctgtgctgtgtgatcccccagagccatgcccgagatagtggatacctgttcgttggcctctccggcttccgtctgccggaccaagcacctgcacctgcgctgcagcgtcgactttactcgccggacgctgaccgggactgctgctctcacggtccagtctcaggaggacaatctgcgcagcctggttttggatacaaaggaccttacaatagaaaaagtagtgatcaatggacaagaagtcaaatatgctcttggagaaagacaaagttacaagggatcgccaatggaaatctctcttcctatcgctttgagcaaaaatcaagaaattgttatagaaatttcttttgagacctctccaaaatcttctgctctccagtggctcactcctgaacagacttctgggaaggaacacccatatctctttagtcagtgccaggccatccactgcagagcaatccttccttgtcaggacactccttctgtgaaattaacctatactgcagaggtgtctgtccctaaagaactggtggcacttatgagtgctattcgtgatggagaaacacctgacccagaagacccaagcaggaaaatatacaaattcatccaaaaagttccaataccctgctacctgattgctttagttgttggagctttagaaagcaggcaaattggcccaagaactttggtgtggtctgagaaagagcaggtggaaaagtctgcttatgagttttctgagactgaatctatgcttaaaatagcagaagatctgggaggaccgtatgtatggggacagtatgacctattggtcctgccaccatccttcccttatggtggcatggagaatccttgccttacttttgtaactcctactctactggcaggcgacaagtcactctccaatgtcattgcacatgaaatatctcatagctggacagggaatctagtgaccaacaaaacttgggatcacttttggttaaatgagggacatactgtgtacttggaacgccacatttgcggacgattgtttggtgaaaagttcagacattttaatgctctgggaggatggggagaactacagaattcggtaaagacatttggggagacacatcctttcaccaaacttgtggttgatctgacagatatagaccctgatgtagcttattcttcagttccctatgagaagggctttgctttacttttttaccttgaacaactgcttggaggaccagagattttcctaggattcttaaaagcttatgttgagaagttttcctataagagcataactactgatgactggaaggatttcctgtattcctattttaaagataaggttgatgttctcaatcaagttgattggaatgcctggctctactctcctggactgcctcccataaagcccaattatgatatgactctgacaaatgcttgtattgccttaagtcaaagatggattactgccaaagaagatgatttaaattcattcaatgccacagacctgaaggatctctcttctcatcaattgaatgagtttttagcacagacgctccagaggatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttctta

SEQ ID NO: 354679 - DNA, 1357 bp, Homo sapiens
atagatcgaggtgtaaccggatggagatgttgagaaagagctggtggaaaagttgcttatgagttttctgagactgaatctatgcttaaaatagcagaagatctgggaggaccgtatgtatggggacagtatgacctattggtcctgccaccatccttcccttatggtggcatggagaatccttgccttacttttgtaactcctactctactggcaggcgaccaagtcactctcccacgtcattgcacatgaaatatctcatagctggacagggaatctagtgaccaacaaaacttgggatcacttttggttaaatgagggacatactgtgtacttggaacgccacatttgcggacgattgtttggtgaaaagttcagacattttaatgctctgggaggatggggagaactacagaattcggtaaagacatttggggagacacatcctttcaccaaacttgtggttgatctgacagatatagaccctgatgtagcttattcttcagttccctatgagaagggctttgctttacttttttaccttgaacaactgcttggaggaccagagattttcctaggattcttaaaagcttatgttgagaagttttcctataagagcataactactgatgactggaaggatttcctgtattcctattttaaagataaggttgatgttctcaatcaagttgattggaatgcctggctctactctcctggactgcctcccataaagcccaattatgatatgactctgacaaatgcttgtattgccttaagtcaaagatggattactgccaaagaagatgatttaaattcattcaatgccacagacctgaaggatctctcttctcatcaattgaatgagtttttagcacagacgctccagagggcacctcttccattggggcacataaagcgaatgcaagaggtgtacaacttcaatgccattaacaattctgaaatacgattcagatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttctta

SEQ ID NO: 354680 - DNA, 2969 bp, Homo sapiens
ttccttttttcccggcgtgcaccgcgaatccctcctcctcttctttacctctctccctcctcctcaggttctctatcgacgagtctggtagctgagcgttgggctgtaggtcgctgtgctgtgtgatcccccagagccatgcccgagatagtggatacctgttcgttggcctctccggcttccgtctgccggaccaagcacctgcacctgcgctgcagcgtcgactttactcgccggacgctgaccgggactgctgctctcacggtccagtctcaggaggacaatctgcgcagcctggttttggatacaaaggaccttacaatagaaaaagtagtgatcaatggacaagaagtcaaatatgctcttggagaaagacaaagttacaagggatcgccaatggaaatctctcttcctatcgctttgagcaaaaatcaagaaattgttatagaaatttcttttgagacctctccaaaatcttctgctctccagtggctcactcctgaacagacttctgggaaggaacacccatatctctttagtcagtgccaggccatccactgcagagcaatccttccttgtcaggacactccttctgtgaaattaacctatactgcagaggtgtctgtccctaaagaactggtggcacttatgagtgctattcgtgatggagaaacacctgacccagaagacccaagcaggaaaatatacaaattcatccaaaaagttccaataccctgctacctgattgctttagttgttggagctttagaaagcaggcaaattggcccaagaactttggtgtggtctgagaaagagcaggtggaaaagtctgcttatgagttttctgagactgaatctatgcttaaaatagcagaagatctgggaggaccgtatgtatggggacagtatgacctattggtcctgccaccatccttcccttatggtggcatggagaatccttgccttacttttgtaactcctactctactggcaggcgacaagtcactctccaatgtcattgcacatgaaatatctcatagctggacagggaatctagtgaccaacaaaacttgggatcacttttggttaaatgagggacatactgtgtacttggaacgccacatttgcggacgattgtttggtgaaaagttcagacattttaatgctctgggaggatggggagaactacagaattcggtaaagacatttggggagacacatcctttcaccaaacttgtggttgatctgacagatatagaccctgatgtagcttattcttcagttccctatgagaagggctttgctttacttttttaccttgaacaactgcttggaggaccagagattttcctaggattcttaaaagcttatgttgagaagttttcctataagagcataactactgatgactggaaggatttcctgtattcctattttaaagataaggttgatgttctcaatcaagttgattggaatgcctggctctactctcctggactgcctcccataaagcccaattatgatatgactctgacaaatgcttgtattgccttaagtcaaagatggattactgccaaagaagatgatttaaattcattcaatgccacagacctgaaggatctctcttctcatcaattgaatgagtttttagcacagacgctccagaggctcctttcttccaaggaatcctgttgaaatgatacggtatacttctttattttgctcttaggcacctcttccattggggcacataaagcgaatgcaagaggtgtacaacttcaatgccattaacaattctgaaatacgattcaggtacatcattttaacttgtctctgtggaagaaagcagaaaactaaactcctttgaaagatggagaaagggaatgcagagtatgagacatacttgagtcttgagaattccttgtcaaactgactgcttctatataaatacttatagtggtatttaaggaatagttgcaatatgtaatctggtagtattaatctttttgttagactttgctctaaacctctcttgccttaaaagaaaaaaaaaaaattagaatgaaggattccgtggtaaataggctttctccacaaccaactaaatctactttgaaatgggaatagttagaaatattttattctattatatgttaatctttcttaattcaaatttgtaatgtgaggcttaaaccaaagtttaattccttcagaaattgcatgtataaggtatgtgagcacctacctgatctttcttaattcaaatttgtaatgtgaggcttaaaccaaagtttaattccttcagaaattggatttataaggtatgtgagcacctacctgatccagacctttaaaaatatatgatctttttcaagaaccagctcctcttctttctcttcaccaattattaaattgtatatataaggatttgagagtctcagaatcaagacataccataaagtggtgtacagtataactatagtggggttattcatatcactacagaagtaatattaagatatacctgtcatatcctgccccttcctcattttctactccatgctccccccaaatcctccttttagatatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttctta

SEQ ID NO: 354681 - DNA, 2149 bp, Homo sapiens
  misc_feature (1645)..(1645): n is a, c, g, or t
  misc_feature (1647)..(1648): n is a, c, g, or t
  misc_feature (1673)..(1674): n is a, c, g, or t
  misc_feature (1677)..(1677): n is a, c, g, or t
  misc_feature (1685)..(1685): n is a, c, g, or t
  misc_feature (1723)..(1723): n is a, c, g, or t
  misc_feature (1728)..(1728): n is a, c, g, or t
  misc_feature (1735)..(1735): n is a, c, g, or t
ttccttttttcccggcgtgcaccgcgaatccctcctcctcttctttacctctctccctcctcctcaggttctctatcgacgagtctggtagctgagcgttgggctgtaggtcgctgtgctgtgtgatcccccagagccatgcccgagatagtggatacctgttcgttggcctctccggcttccgtctgccggaccaagcacctgcacctgcgctgcagcgtcgactttactcgccggacgctgaccgggactgctgctctcacggtccagtctcaggaggacaatctgcgcagcctggttttggatacaaaggaccttacaatagaaaaagtagtgatcaatggacaagaagtcaaatatgctcttggagaaagacaaagttacaagggatcgccaatggaaatctctcttcctatcgctttgagcaaaaatcaagaaattgttatagaaatttcttttgagacctctccaaaatcttctgctctccagtggctcactcctgaacagacttctgggaaggaacacccatatctctttagtcagtgccaggccatccactgcagagcaatccttccttgtcaggacactccttctgtgaaattaacctatactgcagaggtgtctgtccctaaagaactggtggcacttatgagtgctattcgtgatggagaaacacctgacccagaagacccaagcaggaaaatatacaaattcatccaaaaagttccaataccctgctacctgattgctttagttgttggagctttagaaagcaggcaaattggcccaagaactttggtgtggtctgagaaagagcaggtggaaaagtctgcttatgagttttctgagactgaatctatgcttaaaatagcagaagatctgggaggaccgtatgtatggggacagtatgacctattggtcctgccaccatccttcccttatggtggcatggagaatccttgccttacttttgtaactcctactctactggcaggcgacaagtcactctccaatgtcattgcacatgaaatatctcatagctggacagggaatctagtgaccaacaaaacttgggatcacttttggttaaatgagggacatactgtgtacttggaacgccacatttgcggacgattgtttggtgaaaagttcagacattttaatgctctgggaggatggggagaactacagaattcggtaaagacatttggggagacacatcctttcaccaaacttgtggttgatctgacagatatagaccctgatgtagcttattcttcagttccctatgagaagggctttgctttacttttttaccttgaacaactgcttggaggaccagagattttcctaggattcttaaaagcttatgttgagaagttttcctataagagcataactactgatgactggaaggatttcctgtattcctattttaaagataaggttgatgttctcaatcaagttgattggaatgcctggctctactctcctggactgcctcccataaagcccaattatgatatgactctgacaaatgcttgtattgccttaagtcaaagatggattactgccaaagaagatgatttaaattcattcaatgccacagacctgaaggatctctcttctcatcaattgaatgacncnntaccacacaccccccaaagcccacnncanccaatggngcacaaaaaacaaaaacaaaaaaaaaacaacaacaaanccaanaacaaancaaaaaaaccacccagatccctcccgccccccatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttctta

SEQ ID NO: 354682 - DNA, 1262 bp, Homo sapiens
tactttttaatgccatcatactagttcatgataaagctatgctgagttatgtacccatcccccactgatggacattgaggtgttctccttggttgattgacttggaaggctgtctgtcacctggatccattctgcctgtccagtcttatttttctcctttctagtcatgtgaaggttattgcttttagaacttgggttatgcattccttttctgtgtcttcatgtgttatccccttacctataattagaatttctcttctcccttccactgaattacatatattcttcaaggcccaacttaagtcccacctccttttttgaacattctttcactctgaaagtcctcgtagatttccctattctctgaatgttctctgttctctgtggttaatagtacaatgccaaacacgcacacaaaatgtcaaataattacctttctatgaattgatttcttttcttttttactcttagagattttcctaggattcttaaaagcttatgttgagaagttttcctataagagcataactactgatgactggaaggatttcctgtattcctattttaaagataaggttgatgttctcaatcaagttgattggaatgcctggctctactctcctggactgcctcccataaagcccaattatgatatgactctgacaaatgcttgtattgccttaagtcaaagatggattactgccaaagaagatgatttaaattcattcaatgccacagacctgaaggatctctcttctcatcaattgaatgagtttttagcacagacgctccagagggcacctcttccattggggcacataaagcgaatgcaagaggtgtacaacttcaatgccattaacaattctgaaatacgattcagatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttctta

SEQ ID NO: 354683 - DNA, 1024 bp, Homo sapiens
atcctagtgttccagtctccaagttttagattcccctaaagttacaccactgagtgaagtaaagacatttggggagacacatcctttcaccaaacttgtggttgatctgacagatatagaccctgatgtagcttattcttcagttccctatgagaagggctttgctttacttttttaccttgaacaactgcttggaggaccagagattttcctaggattcttaaaagcttatgttgagaagttttcctataagagcataactactgatgactggaaggatttcctgtattcctattttaaagataaggttgatgttctcaatcaagttgattggaatgcctggctctactctcctggactgcctcccataaagcccaaccttgctagagattatgaggacctgaagtcatacaaaggcagtggaaaagaaaggagtaactgagagaagagacgtttgggggctagaatctattggcaactgattggctgtgttatgatatgactctgacaaatgcttgtattgccttaagtcaaagatggattactgccaaagaagatgatttaaattcattcaatgccacagacctgaaggatctctcttctcatcaattgaatgagtttttagcacagacgctccagaggatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttctta

SEQ ID NO: 354684 - DNA, 1473 bp, Homo sapiens
ctgaatacttcacaaagtaaattatccctgtgctcccagtagaatatcctcatctggaataagtttgcacagaatttacttagtgtgcaatttgtttcttttatttttatctgacttatttctatattataaaatatttaggattttaatctggctatgcatttctctccagctcctttcttccaaggaatcctgttgaaatgatacggtatacttctttattttgctcttaggcacctcttccattggggcacataaagcgaatgcaagaggtgtacaacttcaatgccattaacaattctgaaatacgattcaggtacatcattttaacttgtctctgtggaagaaagcagaaaactaaactcctttgaaagatggagaaagggaatgcagagtatgagacatacttgagtcttgagaattccttgtcaaactgactgcttctatataaatacttatagtggtatttaaggaatagttgcaatatgtaatctggtagtattaatctttttgttagactttgctctaaacctctcttgccttaaaagaaaaaaaaaaaattagaatgaaggattccgtggtaaataggctttctccacaaccaactaaatctactttgaaatgggaatagttagaaatattttattctattatatgttaatctttcttaattcaaatttgtaatgtgaggcttaaaccaaagtttaattccttcagaaattgcatgtataaggtatgtgagcacctacctgatctttcttaattcaaatttgtaatgtgaggcttaaaccaaagtttaattccttcagaaattggatttataaggtatgtgagcacctacctgatccagacctttaaaaatatatgatctttttcaagaaccagctcctcttctttctcttcaccaattattaaattgtatatataaggatttgagagtctcagaatcaagacataccataaagtggtgtacagtataactatagtggggttattcatatcactacagaagtaatattaagatatacctgtcatatcctgccccttcctcattttctactccatgctccccccaaatcctccttttagatatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttctta

SEQ ID NO: 354685 - DNA, 607 bp, Homo sapiens
gtcatatcctgccccttcctcattttctactccatgctccccccaaatcctccttttagatatggctgcggctctgcattcaatccaagtgggaggacgcaattcctttggcgctaaagatggcaactgaacaaggaagaatgaagtttacccggcccttattcaagtaagaacccactcagaccgtactttgaattcatctaagaaacaggaagaaaactgtcaaatatttaaacgtaatctatatgacaatattttttaatttgttaaagtttatcagtataattttggaatagggattcacacttataaatatttaaaatgtgaaataatttcattcctctttttagaagcattatatatggattactattttggatcaaatagagttagatactgataaaatagaaataaatcaaagatagccttatatacacaaagatttttaaaggtaactagaagataattggtgggtaggtatagacaagaaagagagtctgaagttaaatgtaaggagaaataagcagataaagctaactcttttgtgttcaaatgttgcatagaggtcaagggtaggttgcttgacataataaaggaatgcttagtg

SEQ ID NO: 354686 - DNA, 465 bp, Homo sapiens
atcataggctgtggtgggaaacaggagctcaggtagggaggggtgattacgatagaatgtttcgaattttgtgttggaaacaggtggcacaaatcatcagtaaacccttttaacgtctaaaaaaggtatcagcaaaaataatactttagatttttttcctagcacttcattaagaagtgccatacattatctcgttaatttttacaacagccttgctagagattatgaggacctgaagtcatacaaaggcagtggaaaagaaaggagtaactgagagaagagacgtttgggggctagaatctattggcaactgattggctgtggtgagaaaagaagaaattaaaaatgactgagcagagatgtaataaagattcagctcaatccagcacacatttattgtcaggcactaatatgatgaataaggaactcacagagcaaatatgtatgtatcaagtaattataata

SEQ ID NO: 354687 - DNA, 2133 bp, Homo sapiens
ttccttttttcccggcgtgcaccgcgaatccctcctcctcttctttacctctctccctcctcctcaggttctctatcgacgagtctggtagctgagcgttgggctgtaggtcgctgtgctgtgtgatcccccagagccatgcccgagatagtggatacctgttcgttggcctctccggcttccgtctgccggaccaagcacctgcacctgcgctgcagcgtcgactttactcgccggacgctgaccgggactgctgctctcacggtccagtctcaggaggacaatctgcgcagcctggttttggatacaaaggaccttacaatagaaaaagtagtgatcaatggacaagaagtcaaatatgctcttggagaaagacaaagttacaagggatcgccaatggaaatctctcttcctatcgctttgagcaaaaatcaagaaattgttatagaaatttcttttgagacctctccaaaatcttctgctctccagtggctcactcctgaacagacttctgggaaggaacacccatatctctttagtcagtgccaggccatccactgcagagcaatccttccttgtcaggacactccttctgtgaaattaacctatactgcagaggtgtctgtccctaaagaactggtggcacttatgagtgctattcgtgatggagaaacacctgacccagaagacccaagcaggaaaatatacaaattcatccaaaaagttccaataccctgctacctgattgctttagttgttggagctttagaaagcaggcaaattggcccaagaactttggtgtggtctgagaaagagcaggtggaaaagtctgcttatgagttttctgagactgaatctatgcttaaaatagcagaagatctgggaggaccgtatgtatggggacagtatgacctattggtcctgccaccatccttcccttatggtggcatggagaatccttgccttacttttgtaactcctactctactggcaggcgacaagtcactctccaatgtcattgcacatgaaatatctcatagctggacagggaatctagtgaccaacaaaacttgggatcacttttggttaaatgagggacatactgtgtacttggaacgccacatttgcggacgattgtttggtgaaaagttcagacattttaatgctctgggaggatggggagaactacagaattcggtaaagacatttggggagacacatcctttcaccaaacttgtggttgatctgacagatatagaccctgatgtagcttattcttcagttccctatgagaagggctttgctttacttttttaccttgaacaactgcttggaggaccagagattttcctaggattcttaaaagcttatgttgagaagttttcctataagagcataactactgatgactggaaggatttcctgtattcctattttaaagataaggttgatgttctcaatcaagttgattggaatgcctggctctactctcctggactgcctcccataaagcccaattatgatatgactctgacaaatgcttgtattgccttaagtcaaagatggattactgccaaagaagatgatttaaattcattcaatgccacagacctgaaggatctctcttctcatcaattgaatgagtttttagcacagacgctccagagggcacctcttccattggggcacataaagcgaatgcaagaggtgtacaacttcaatgccattaacaattctgaaatacgattcagatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttctta

SEQ ID NO: 354688 - DNA, 457 bp, Homo sapiens
ttccttttttcccggcgtgcaccgcgaatccctcctcctcttctttacctctctccctcctcctcaggttctctatcgacgagtctggtagctgagcgttgggctgtaggtcgctgtgctgtgtgatcccccagagccatgcccgagatagtggatacctgttcgttggcctctccggcttccgtctgccggaccaagcacctgcacctgcgctgcagcgtcgactttactcgccggacgctgaccgggactgctgctctcacggtccagtctcaggaggacaatctgcgcagcctggttttggatacaaaggaccttacaatagaaaaagtagtgatcaatggacaagaagtcaaatatgctcttggagaaagacaaagttacaagggatcgccaatggaaatctctcttcctatcgctttgagcaatcaagattgttatgatctttctcttttac

SEQ ID NO: 354689 - DNA, 2078 bp, Homo sapiens
ttccttttttcccggcgtgcaccgcgaatccctcctcctcttctttacctctctccctcctcctcaggttctctatcgacgagtctggtagctgagcgttgggctgtaggtcgctgtgctgtgtgatcccccagagccatgcccgagatagtggatacctgttcgttggcctctccggcttccgtctgccggaccaagcacctgcacctgcgctgcagcgtcgactttactcgccggacgctgaccgggactgctgctctcacggtccagtctcaggaggacaatctgcgcagcctggttttggatacaaaggaccttacaatagaaaaagtagtgatcaatggacaagaagtcaaatatgctcttggagaaagacaaagttacaagggatcgccaatggaaatctctcttcctatcgctttgagcaaaaatcaagaaattgttatagaaatttcttttgagacctctccaaaatcttctgctctccagtggctcactcctgaacagacttctgggaaggaacacccatatctctttagtcagtgccaggccatccactgcagagcaatccttccttgtcaggacactccttctgtgaaattaacctatactgcagaggtgtctgtccctaaagaactggtggcacttatgagtgctattcgtgatggagaaacacctgacccagaagacccaagcaggaaaatatacaaattcatccaaaaagttccaataccctgctacctgattgctttagttgttggagctttagaaagcaggcaaattggcccaagaactttggtgtggtctgagaaagagcaggtggaaaagtctgcttatgagttttctgagactgaatctatgcttaaaatagcagaagatctgggaggaccgtatgtatggggacagtatgacctattggtcctgccaccatccttcccttatggtggcatggagaatccttgccttacttttgtaactcctactctactggcaggcgacaagtcactctccaatgtcattgcacatgaaatatctcatagctggacagggaatctagtgaccaacaaaacttgggatcacttttggttaaatgagggacatactgtgtacttggaacgccacatttgcggacgattgtttggtgaaaagttcagacattttaatgctctgggaggatggggagaactacagaattcggtaaagacatttggggagacacatcctttcaccaaacttgtggttgatctgacagatatagaccctgatgtagcttattcttcagttccctatgagaagggctttgctttacttttttaccttgaacaactgcttggaggaccagagattttcctaggattcttagatttccctgattcctattttaaagataggttgatgttctcaatcaagttgattggaatgcctggctctactctcctggactgcctcccataaagcccaattatgatatgactctgacaaatgcttgtattgccttaagtcaaagatggattactgccaaagaagatgatttaaattcattcaatgccacagacctgaaggatctctcttctcatcaattgaatgagtttttagcacagacgctccagagggcacctcttccattggggcacataaagcgaatgcaagaggtgtacaacttcaatgccattaacaattctgaaatacgattcagatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttctta

SEQ ID NO: 354690 - DNA, 2334 bp, Homo sapiens
ttccttttttcccggcgtgcaccgcgaatccctcctcctcttctttacctctctccctcctcctcaggttctctatcgacgagtctggtagctgagcgttgggctgtaggtcgctgtgctgtgtgatcccccagagccatgcccgagatagtggatacctgttcgttggcctctccggcttccgtctgccggaccaagcacctgcacctgcgctgcagcgtcgactttactcgccggacgctgaccgggactgctgctctcacggtccagtctcaggaggacaatctgcgcagcctggttttggatacaaaggaccttacaatagaaaaagtagtgatcaatggacaagaagtcaaatatgctcttggagaaagacaaagttacaagggatcgccaatggaaatctctcttcctatcgctttgagcaaaaatcaagaaattgttatagaaatttcttttgagacctctccaaaatcttctgctctccagtggctcactcctgaacagacttctgggaaggaacacccatatctctttagtcagtgccaggccatccactgcagagcaatccttccttgtcaggacactccttctgtgaaattaacctatactgcagaggtgtctgtccctaaagaactggtggcacttatgagtgctattcgtgatggagaaacacctgacccagaagacccaagcaggaaaatatacaaattcatccaaaaagttccaataccctgctacctgattgctttagttgttggagctttagaaagcaggcaaattggcccaagaactttggtgtggtctgagaaagagcaggtggaaaagtctgcttatgagttttctgagactgaatctatgcttaaaatagcagaagatctgggaggaccgtatgtatggggacagtatgacctattggtcctgccaccatccttcccttatggtggcatggagaatccttgccttacttttgtaactcctactctactggcaggcgacaagtcactctccaatgtcattgcacatgaaatatctcatagctggacagggaatctagtgaccaacaaaacttgggatcacttttggttaaatgagggacatactgtgtacttggaacgccacatttgcggacgattgtttggtgaaaagttcagacattttaatgctctgggaggatggggagaactacagaattcggtaaagacatttggggagacacatcctttcaccaaacttgtggttgatctgacagatatagaccctgatgtagcttattcttcagttccctatgagaagggctttgctttacttttttaccttgaacaactgcttggaggaccagagattttcctaggattcttaaaagcttatgttgagaagttttcctataagagcataactactgatgactggaaggatttcctgtattcctattttaaagataaggttgatgttctcaatcaagttgattggaatgcctggctctactctcctggactgcctcccataaagcccaattatgatatgactctgacaaatgcttgtattgccttaagtcaaagatggattactgccaaagaagatgatttaaattcattcaatgccacagacctgaaggatctctcttctcatcaattgaatgagtttttagcacagacgctccagagggcacctcttccattggggcacataaagcgaatgcaagaggtgtacaacttcaatgccattaacaattctgaaatacgattcagatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttcttatagtggcatattctttgtaatttacagttcactttggttccattaaatttgattatttaagaacacaaaaaaaaaaaaaaaaaaaggggggcaaaattacggggcaatagcacatttgaagaggacaagagaaaaagagggaaaagggaaaggttgacactgggagcaacacaacgaaatgttagtggtggataaaaaaat

SEQ ID NO: 354691 - DNA, 1142 bp, Homo sapiens
attaatcacactgttttctttaggtcattgcacatgaaatatctcatagctggacagggaatctagtgaccaacaaaacttgggatcacttttggttaaatgagggacatactgtgtacttggaacgccacatttgcggacgattgtttggtgaaaagttcagacattttaatgctctgggaggatggggagaactacagaattcggtaaagacatttggggagacacatcctttcaccaaacttgtggttgatctgacagatatagaccctgatgtagcttattcttcagttccctatgagaagggctttgctttacttttttaccttgaacaactgcttggaggaccagagattttcctaggattcttaaaagcttatgttgagaagttttcctataagagcataactactgatgactggaaggatttcctgtattcctattttaaagataaggttgatgttctcaatcaagttgattggaatgcctggctctactctcctggactgcctcccataaagcccaattatgatatgactctgacaaatgcttgtattgccttaagtcaaagatggattactgccaaagaagatgatttaaattcattcaatgccacagacctgaaggatctctcttctcatcaattgaatgagtttttagcacagacgctccagagggcacctcttccattggggcacataaagcgaatgcaagaggtgtacaacttcaatgccattaacaattctgaaatacgattcagatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttctta

SEQ ID NO: 354692 - DNA, 2908 bp, Homo sapiens
ttccttttttcccggcgtgcaccgcgaatccctcctcctcttctttacctctctccctcctcctcaggttctctatcgacgagtctggtagctgagcgttgggctgtaggtcgctgtgctgtgtgatcccccagagccatgcccgagatagtggatacctgttcgttggcctctccggcttccgtctgccggaccaagcacctgcacctgcgctgcagcgtcgactttactcgccggacgctgaccgggactgctgctctcacggtccagtctcaggaggacaatctgcgcagcctggttttggatacaaaggaccttacaatagaaaaagtagtgatcaatggacaagaagtcaaatatgctcttggagaaagacaaagttacaagggatcgccaatggaaatctctcttcctatcgctttgagcaaaaatcaagaaattgttatagaaatttcttttgagacctctccaaaatcttctgctctccagtggctcactcctgaacagacttctgggaaggaacacccatatctctttagtcagtgccaggccatccactgcagagcaatccttccttgtcaggacactccttctgtgaaattaacctatactgcagaggtgtctgtccctaaagaactggtggcacttatgagtgctattcgtgatggagaaacacctgacccagaagacccaagcaggaaaatatacaaattcatccaaaaagttccaataccctgctacctgattgctttagttgttggagctttagaaagcaggcaaattggcccaagaactttggtgtggtctgagaaagagcaggtggaaaagtctgcttatgagttttctgagactgaatctatgcttaaaatagcagaagatctgggaggaccgtatgtatggggacagtatgacctattggtcctgccaccatccttcccttatggtggcatggagaatccttgccttacttttgtaactcctactctactggcaggcgacaagtcactctccaatgtcattgcacatgaaatatctcatagctggacagggaatctagtgaccaacaaaacttgggatcacttttggttaaatgagggacatactgtgtacttggaacgccacatttgcggacgattgtttggtgaaaagttcagacattttaatgctctgggaggatggggagaactacagaattcggtaaagacatttggggagacacatcctttcaccaaacttgtggttgatctgacagatatagaccctgatgtagcttattcttcagttccctatgagaagggctttgctttacttttttaccttgaacaactgcttggaggaccagagattttcctaggattcttaaaagcttatgttgagaagttttcctataagagcataactactgatgactggaaggatttcctgtattcctattttaaagataaggttgatgttctcaatcaagttgattggaatgcctggctctactctcctggactgcctcccataaagcccaattatgatatgactctgacaaatgcttgtattgccttaagtcaaagatggattactgccaaagaagatgatttaaattcattcaatgccacagacctgaaggatctctcttctcatcaattgaatgagtttttagcacagacgctccagagggcacctcttccattggggcacataaagcgaatgcaagaggtgtacaacttcaatgccattaacaattctgaaatacgattcaggtacatcattttaacttgtctctgtggaagaaagcagaaaactaaactcctttgaaagatggagaaagggaatgcagagtatgagacatacttgagtcttgagaattccttgtcaaactgactgcttctatataaatacttatagtggtatttaaggaatagttgcaatatgtaatctggtagtattaatctttttgttagactttgctctaaacctctcttgccttaaaagaaaaaaaaaaaattagaatgaaggattccgtggtaaataggctttctccacaaccaactaaatctactttgaaatgggaatagttagaaatattttattctattatatgttaatctttcttaattcaaatttgtaatgtgaggcttaaaccaaagtttaattccttcagaaattgcatgtataaggtatgtgagcacctacctgatctttcttaattcaaatttgtaatgtgaggcttaaaccaaagtttaattccttcagaaattggatttataaggtatgtgagcacctacctgatccagacctttaaaaatatatgatctttttcaagaaccagctcctcttctttctcttcaccaattattaaattgtatatataaggatttgagagtctcagaatcaagacataccataaagtggtgtacagtataactatagtggggttattcatatcactacagaagtaatattaagatatacctgtcatatcctgccccttcctcattttctactccatgctccccccaaatcctccttttagatatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttctta

SEQ ID NO: 354693 - DNA, 2127 bp, Homo sapiens
ttccttttttcccggcgtgcaccgcgaatccctcctcctcttctttacctctctccctcctcctcaggttctctatcgacgagtctggtagctgagcgttgggctgtaggtcgctgtgctgtgtgatcccccagagccatgcccgagatagtggatacctgttcgttggcctctccggcttccgtctgccggaccaagcacctgcacctgcgctgcagcgtcgactttactcgccggacgctgaccgggactgctgctctcacggtccagtctcaggaggacaatctgcgcagcctggttttggatacaaaggaccttacaatagaaaaagtagtgatcaatggacaagaagtcaaatatgctcttggagaaagacaaagttacaagggatcgccaatggaaatctctcttcctatcgctttgagcaaaaatcaagaaattgttatagaaatttcttttgagacctctccaaaatcttctgctctccagtggctcactcctgaacagacttctgggaaggaacacccatatctctttagtcagtgccaggccatccactgcagagcaatccttccttgtcaggacactccttctgtgaaattaacctatactgcagaggtgtctgtccctaaagaactggtggcacttatgagtgctattcgtgatggagaaacacctgacccagaagacccaagcaggaaaatatacaaattcatccaaaaagttccaataccctgctacctgattgctttagttgttggagctttagaaagcaggcaaattggcccaagaactttggtgtggtctgagaaagagcaggtggaaaagtctgcttatgagttttctgagactgaatctatgcttaaaatagcagaagatctgggaggaccgtatgtatggggacagtatgacctattggtcctgccaccatccttcccttatggtggcatggagaatccttgccttacttttgtaactcctactctactggcaggcgacaagtcactctccaatgtcattgcacatgaaatatctcatagctggacagggaatctagtgaccaacaaaacttgggatcacttttggttaaatgagggacatactgtgtacttggaacgccacatttgcggacgattgtttggtgaaaagttcagacattttaatgctctgggaggatggggagaactacagaattcggtaaagacatttggggagacacatcctttcaccaaacttgtggttgatctgacagatatagaccctgatgtagcttattcttcagttccctatgagaagggctttgctttacttttttaccttgaacaactgcttggaggaccagagattttcctaggattcttaaaagcttatgttgagaagttttcctataagagcataactactgatgactggaaggatttcctgtattcctattttaaagataaggttgatgttctcaatcaagttgattggaatgcctggctctactctcctggactgcctcccataaagcccaattatgatatgactctgacaaatgcttgtattgccttaagtcaaagatggattactgccaaagaagatgatttaaattcattcaatgccacagacctgaaggatctctcttctcatcaattgaatgagtttttagcacagacgctccagaggatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttcttatagtggcatattctttgtaaattttaacaaggtttaatcttttgatttacaaattaaaaaattttgaattagcttta

SEQ ID NO: 354694 - DNA, 1276 bp, Homo sapiens
gaaagagggatgttttgcaagaattttgcacacactacatgttctttcccattgttgcaaaatatgatttctaagttgagaacacacaaatattggtataatttgcttaacaattaccatgtgttaatttcattttcttctaaaaaggaatgaaatcatcaggcaatggtatcgggctctctcaagggtctagcatctagaacggtgccaattatgtagcaggtgcttgcaggtttgttagatgattagatgtttggaacaaccaagtaaaatccatgacagcaaggacttgatgttgttcatcttgttgtcttgagtgcctagaactgttcctgccatgtactaaatatgctccaactgattccaactactttagcatatactactcgagcacatgacagtcttttgctgaggtgctttggcattctttctaaaagatagatgggtgtttcattaatgtggtatccatttgggtttgtgagttcttggatgatgccagtagtatgtaagttaggtaaaatatttcctattttcctcactttggagtttgttttccttatttaaaagggactttgaaatttaagtatgtactgtagctttaaaactgcatttctgcaaaagcacgtgcatttttaaacaatgtaatctttatctttgcagttatgatatgactctgacaaatgcttgtattgccttaagtcaaagatggattactgccaaagaagatgatttaaattcattcaatgccacagacctgaaggatctctcttctcatcaattgaatgagtttttagcacagacgctccagagggcacctcttccattggggcacataaagcgaatgcaagaggtgtacaacttcaatgccattaacaattctgaaatacgattcagatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttctta

SEQ ID NO: 354695 - DNA, 506 bp, Homo sapiens
agaaagaaagagtagtcacgtgctcccagaaggactctaagtcaagtcacagagctaaaaatacatgaaggtggcaccagctcatggggcactgggcctggctctgcagaggcctctgccttccttcactgtgcaccctgggctcatgcaccaaggcagagaacaggaagaagtgaggggacaagaagaaggcagaatgtccagatggaggataagaccaaagagccagcacctacaggacttgggctgcttcaggctgaacgctgggagaccacttcctgtgctgacacacagagctcccatctccatgaagaccgcacagcgcgtgtaagccagcccagctgacctaaagcgacatgagactactagaaagaaacgacacccttccccaagcccccacagctactccaacccaaacaacaaccaagccagtttaatggtaggaatttgtattttttgcctttgttcagaatacatgacattggtaaatatgccacatgcctttg

SEQ ID NO: 354696 - DNA, 872 bp, Homo sapiens
tggtaacaccaagtgacttgtcaaaggtcacggagccagtaagtggaacaaccagggtttcagagctttttctgctactctagtagttcttacctgaagattgatggtaactcttaattttgcatgtgtatttttcctggtgggagatccatagctttcactaaattatcctagagtaagtgatcccaaaatggtgatggccatcatgtgtaccatgctacctttccagagccccatttctttgtggttccatgtgatggaaaataagctcaaccggcctgtcaggcgaggaagaggcaggtgtatgcccacaacatgcccacagcttggagatcaggtgacctcaaggaggaagtagcccacaaatcacccctcttttcctcttcacagtggagttccaggtgatgacacagacccaatccctgagcttcctgctggggtcctcagcctccttggactgtggcttctccatggcaccgggcttggacctcatcagtgtggagtggcgactgcagcacaagggcaggggtcagttggtgtacagctggaccgcagggcaggggcaggctgtgcggaagggcgctaccctggagcctgcacaactgggcatggccagggatgcctccctcaccctgcccggcctcactatacaggacgaggggacctacatttgccagatcaccacctctctgtaccgagctcagcagatcatccagctcaacatccaaggtgaggccaggacatggttatcccagggaaggggatataacatgtctactgggagcgtttccagattgggacccaaatgcaagaatgatttcctgagaagcaggcttcaatcccacaacttaaatgccatcaccaccatggaa

SEQ ID NO: 354697 - DNA, 3357 bp, Homo sapiens
tgccatcttgctctaagtgaaagtgaaagaaaagtcggcagcagagggaacagggaagaaacctaaaggctgcaggctgccaggtgtgcttggagagcccccttcttccgccgggcctcgcaagcagcgtaggactgtggagaagggcggtgggcaaggagggaactcgagagcagcctccatgggcacacaggagggctggtgcctgctgctctgcctggctctatctggagcagcagaaaccaagccccacccagcagaggggcagtggcgggcagtggacgtggtcctagactgtttcctggcgaaggacggtgcgcaccgtggagctctcgccagcagtgaggacagggcaagggcctcccttgtgctgaagcaggtgccagtgctggacgatggctccctggaggacttcaccgatttccaagggggcacactggcccaagatgacccacctattatctttgaggcctcagtggacctggtccagattccccaggccgaggccttgctccatgctgactgcagtgggaaggaggtgacctgtgagatctcccgctactttctccagatgacagagaccactgttaagacagcagcttggttcatggccaacgtgcaggtctctggagggggacctagcatctccttggtgatgaagactcccagggtcgccaagaatgaggcgctctggcacccgacgctgaacttgccactgagcccccaggggactgtgcgaactgcagtggagttccaggtgatgacacagacccaatccctgagcttcctgctggggtcctcagcctccttggactgtggcttctccatggcaccgggcttggacctcatcagtgtggagtggcgactgcagcacaagggcaggggtcagttggtgtacagctggaccgcagggcaggggcaggctgtgcggaagggcgctaccctggagcctgcacaactgggcatggccagggatgcctccctcaccctgcccggcctcactatacaggacgaggggacctacatttgccagatcaccacctctctgtaccgagctcagcagatcatccagctcaacatccaagcttcccctaaagtacgactgagcttggcaaacgaagctctgctgcccaccctcatctgcgacattgctggctattaccctctggatgtggtggtgacgtggacccgagaggagctgggtggatccccagcccaagtctctggtgcctccttctccagcctcaggcaaagcgtggcaggcacctacagcatctcctcctctctcaccgcagaacctggctctgcaggtgccacttacacctgccaggtcacacacatctctctggaggagccccttggggccagcacccaggttgtcccaccagagcggagaacagccttgggagtcatctttgccagcagtctcttccttcttgcactgatgttcctggggcttcagagacggcaagcacctacaggacttgggctgcttcaggctgaacgctgggagaccacttcctgtgctgacacacagagctcccatctccatgaagaccgcacagcgcgtgtaagccagcccagctgacctaaagcgacatgagactactagaaagaaacgacacccttccccaagcccccacagctactccaacccaaacaacaaccaagccagtttaatggtaggaatttgtattttttgcctttgttcagaatacatgacattggtaaatatgccacatgcctttggtggaagtacaactgttgttattactctatacaagtatgagatcagggttaggaaaaaaagacaaagaggtgatgacagacacacagtggaaaccccacatcgtctcatggcaaaccgaagaacgggatgtgggaagctcagcttcatttgactgcaaagtcccagggttttgttgcacatttgctcatgcacatgggtggtgggaggaaagggggatagcaaagacacacagaagagggtacagggtgggtgagaaagaaagtagaagggctaatacccccaaagaacaaggccaactacacctggtgagcctcagagggacagaaacccaggaatgattcctgtgatagggctgggagagccaagaggacggattcgctccaggcttgggacacatcgaggacagtggtggttcttctccagcggtgaccccctgcattaggcaaggaggagcccagaggagagtggagaccttcgaggggggccgttgggagggtactgactgctttcttccagctcttcagtcccgcccttgggcaggacgaagggaatgtgggaaacaagggcgaagggaaaggaaggatggttttgagcaatgaaatgctgctgcatggaaagtgggcatccagaccctgcccagcatggcctcagcctcttcctgttcgtggaccgagggaagaaggaataaagggccatgggcattctccgctctgctcccagcctgccctcctccccttgcacctgggcttatcccacattaatagcccatcctgaagctcagcaattgccccgaagataggctgagcagatcccatcctcaggttccactgtctatacacacaaaccatgcaaagaggaggaagagaaaggaggcaaagtagaattcagacaggaaagggtggttcaaaggggaatatactacaggaagaacagagaggcggctctcaaggagagggccccatgacagcacagcaatacacaagcacacctgacacaggctggcacgcctccccccaaggtggggctggtgggtctacatgacttctctgcatcctgaggatcggccgggccccaggaagaaccacttgcctcatccctgtctttggcaagtgcacgggtggtgtggaggaaaggattccatgggtgtccaaagatctcacactgctaacaccctcacgctccttcatcaacaggaagagaggaacaggaccctctttaacgagggcaaggagtggcttcctctgagcttgttactttcaaattaagcacttgactcactgtttctctataactaacaggcaatctctctctttatgccaacaattaactgggagctaggttaaattatttggctagataaaactaccagctagatggatttatttggtgccctcatacagaatgctgtagaaaatgtaaagaagagaaagctccttccagctagaagcacatgggactgcttctaggatggaaacaagtcctgctattttcacaatccctaagtgttctccaggcctctggagaacaaagtaaagttgtaagatccccaaagacacggaaaatcctggacgaacagattagaaataactacaaaaaacaagttttta

SEQ ID NO: 354698 - DNA, 3232 bp, Homo sapiens
tgccatcttgctctaagtgaaagtgaaagaaaagtcggcagcagagggaacagggaagaaacctaaaggctgcaggctgccaggtgtgcttggagagcccccttcttccgccgggcctcgcaagcagcgtaggactgtggagaagggcggtgggcaaggagggaactcgagagcagcctccatgggcacacaggagggctggtgcctgctgctctgcctggctctatctggagcagcagaaaccaagccccacccagcagaggggcagtggcgggcagtggacgtggtcctagactgtttcctggcgaaggacggtgcgcaccgtggagctctcgccagcagtgaggacagggcaagggcctcccttgtgctgaagcaggtgccagtgctggacgatggctccctggaggacttcaccgatttccaagggggcacactggcccaagatgacccacctattatctttgaggcctcagtggacctggtccagattccccaggccgaggccttgctccatgctgactgcagtgggaaggaggtgacctgtgagatctcccgctactttctccagatgacagagaccactgttaagacagcagcttggttcatggccaacgtgcaggtctctggagggggacctagcatctccttggtgatgaagactcccagggtcgccaagaatgaggcgctctggcacccgacgctgaacttgccactgagcccccaggggactgtgcgaactgcagtggagttccaggtgatgacacagacccaatccctgagcttcctgctggggtcctcagcctccttggactgtggcttctccatggcaccgggcttggacctcatcagtgtggagtggcgactgcagcacaagggcaggggacgaggggacctacatttgccagatcaccacctctctgtaccgagctcagcagatcatccagctcaacatccaagcttcccctaaagtacgactgagcttggcaaacgaagctctgctgcccaccctcatctgcgacattgctggctattaccctctggatgtggtggtgacgtggacccgagaggagctgggtggatccccagcccaagtctctggtgcctccttctccagcctcaggcaaagcgtggcaggcacctacagcatctcctcctctctcaccgcagaacctggctctgcaggtgccacttacacctgccaggtcacacacatctctctggaggagccccttggggccagcacccaggttgtcccaccagagcggagaacagccttgggagtcatctttgccagcagtctcttccttcttgcactgatgttcctggggcttcagagacggcaagcacctacaggacttgggctgcttcaggctgaacgctgggagaccacttcctgtgctgacacacagagctcccatctccatgaagaccgcacagcgcgtgtaagccagcccagctgacctaaagcgacatgagactactagaaagaaacgacacccttccccaagcccccacagctactccaacccaaacaacaaccaagccagtttaatggtaggaatttgtattttttgcctttgttcagaatacatgacattggtaaatatgccacatgcctttggtggaagtacaactgttgttattactctatacaagtatgagatcagggttaggaaaaaaagacaaagaggtgatgacagacacacagtggaaaccccacatcgtctcatggcaaaccgaagaacgggatgtgggaagctcagcttcatttgactgcaaagtcccagggttttgttgcacatttgctcatgcacatgggtggtgggaggaaagggggatagcaaagacacacagaagagggtacagggtgggtgagaaagaaagtagaagggctaatacccccaaagaacaaggccaactacacctggtgagcctcagagggacagaaacccaggaatgattcctgtgatagggctgggagagccaagaggacggattcgctccaggcttgggacacatcgaggacagtggtggttcttctccagcggtgaccccctgcattaggcaaggaggagcccagaggagagtggagaccttcgaggggggccgttgggagggtactgactgctttcttccagctcttcagtcccgcccttgggcaggacgaagggaatgtgggaaacaagggcgaagggaaaggaaggatggttttgagcaatgaaatgctgctgcatggaaagtgggcatccagaccctgcccagcatggcctcagcctcttcctgttcgtggaccgagggaagaaggaataaagggccatgggcattctccgctctgctcccagcctgccctcctccccttgcacctgggcttatcccacattaatagcccatcctgaagctcagcaattgccccgaagataggctgagcagatcccatcctcaggttccactgtctatacacacaaaccatgcaaagaggaggaagagaaaggaggcaaagtagaattcagacaggaaagggtggttcaaaggggaatatactacaggaagaacagagaggcggctctcaaggagagggccccatgacagcacagcaatacacaagcacacctgacacaggctggcacgcctccccccaaggtggggctggtgggtctacatgacttctctgcatcctgaggatcggccgggccccaggaagaaccacttgcctcatccctgtctttggcaagtgcacgggtggtgtggaggaaaggattccatgggtgtccaaagatctcacactgctaacaccctcacgctccttcatcaacaggaagagaggaacaggaccctctttaacgagggcaaggagtggcttcctctgagcttgttactttcaaattaagcacttgactcactgtttctctataactaacaggcaatctctctctttatgccaacaattaactgggagctaggttaaattatttggctagataaaactaccagctagatggatttatttggtgccctcatacagaatgctgtagaaaatgtaaagaagagaaagctccttccagctagaagcacatgggactgcttctaggatggaaacaagtcctgctattttcacaatccctaagtgttctccaggcctctggagaacaaagtaaagttgtaagatccccaaagacacggaaaatcctggacgaacagattagaaataactacaaaaaacaagttttta

SEQ ID NO: 354699 - DNA, 3195 bp, Homo sapiens
tgccatcttgctctaagtgaaagtgaaagaaaagtcggcagcagagggaacagggaagaaacctaaaggctgcaggctgccagagccccacccagcagaggggcagtggcgggcagtggacgtggtcctagactgtttcctggcgaaggacggtgcgcaccgtggagctctcgccagcagtgaggacagggcaagggcctcccttgtgctgaagcaggtgccagtgctggacgatggctccctggaggacttcaccgatttccaagggggcacactggcccaagatgacccacctattatctttgaggcctcagtggacctggtccagattccccaggccgaggccttgctccatgctgactgcagtgggaaggaggtgacctgtgagatctcccgctactttctccagatgacagagaccactgttaagacagcagcttggttcatggccaacgtgcaggtctctggagggggacctagcatctccttggtgatgaagactcccagggtcgccaagaatgaggcgctctggcacccgacgctgaacttgccactgagcccccaggggactgtgcgaactgcagtggagttccaggtgatgacacagacccaatccctgagcttcctgctggggtcctcagcctccttggactgtggcttctccatggcaccgggcttggacctcatcagtgtggagtggcgactgcagcacaagggcaggggtcagttggtgtacagctggaccgcagggcaggggcaggctgtgcggaagggcgctaccctggagcctgcacaactgggcatggccagggatgcctccctcaccctgcccggcctcactatacaggacgaggggacctacatttgccagatcaccacctctctgtaccgagctcagcagatcatccagctcaacatccaagcttcccctaaagtacgactgagcttggcaaacgaagctctgctgcccaccctcatctgcgacattgctggctattaccctctggatgtggtggtgacgtggacccgagaggagctgggtggatccccagcccaagtctctggtgcctccttctccagcctcaggcaaagcgtggcaggcacctacagcatctcctcctctctcaccgcagaacctggctctgcaggtgccacttacacctgccaggtcacacacatctctctggaggagccccttggggccagcacccaggttgtcccaccagagcggagaacagccttgggagtcatctttgccagcagtctcttccttcttgcactgatgttcctggggcttcagagacggcaagcacctacaggacttgggctgcttcaggctgaacgctgggagaccacttcctgtgctgacacacagagctcccatctccatgaagaccgcacagcgcgtgtaagccagcccagctgacctaaagcgacatgagactactagaaagaaacgacacccttccccaagcccccacagctactccaacccaaacaacaaccaagccagtttaatggtaggaatttgtattttttgcctttgttcagaatacatgacattggtaaatatgccacatgcctttggtggaagtacaactgttgttattactctatacaagtatgagatcagggttaggaaaaaaagacaaagaggtgatgacagacacacagtggaaaccccacatcgtctcatggcaaaccgaagaacgggatgtgggaagctcagcttcatttgactgcaaagtcccagggttttgttgcacatttgctcatgcacatgggtggtgggaggaaagggggatagcaaagacacacagaagagggtacagggtgggtgagaaagaaagtagaagggctaatacccccaaagaacaaggccaactacacctggtgagcctcagagggacagaaacccaggaatgattcctgtgatagggctgggagagccaagaggacggattcgctccaggcttgggacacatcgaggacagtggtggttcttctccagcggtgaccccctgcattaggcaaggaggagcccagaggagagtggagaccttcgaggggggccgttgggagggtactgactgctttcttccagctcttcagtcccgcccttgggcaggacgaagggaatgtgggaaacaagggcgaagggaaaggaaggatggttttgagcaatgaaatgctgctgcatggaaagtgggcatccagaccctgcccagcatggcctcagcctcttcctgttcgtggaccgagggaagaaggaataaagggccatgggcattctccgctctgctcccagcctgccctcctccccttgcacctgggcttatcccacattaatagcccatcctgaagctcagcaattgccccgaagataggctgagcagatcccatcctcaggttccactgtctatacacacaaaccatgcaaagaggaggaagagaaaggaggcaaagtagaattcagacaggaaagggtggttcaaaggggaatatactacaggaagaacagagaggcggctctcaaggagagggccccatgacagcacagcaatacacaagcacacctgacacaggctggcacgcctccccccaaggtggggctggtgggtctacatgacttctctgcatcctgaggatcggccgggccccaggaagaaccacttgcctcatccctgtctttggcaagtgcacgggtggtgtggaggaaaggattccatgggtgtccaaagatctcacactgctaacaccctcacgctccttcatcaacaggaagagaggaacaggaccctctttaacgagggcaaggagtggcttcctctgagcttgttactttcaaattaagcacttgactcactgtttctctataactaacaggcaatctctctctttatgccaacaattaactgggagctaggttaaattatttggctagataaaactaccagctagatggatttatttggtgccctcatacagaatgctgtagaaaatgtaaagaagagaaagctccttccagctagaagcacatgggactgcttctaggatggaaacaagtcctgctattttcacaatccctaagtgttctccaggcctctggagaacaaagtaaagttgtaagatccccaaagacacggaaaatcctggacgaacagattagaaataactacaaaaaacaagttttta

SEQ ID NO: 354700 - DNA, 3001 bp, Homo sapiens
tgccatcttgctctaagtgaaagtgaaagaaaagtcggcagcagagggaacagggaagaaacctaaaggctgcaggctgccaggtgtgcttggagagcccccttcttccgccgggcctcgcaagcagcgtaggactgtggagaagggcggtgggcaaggagggaactcgagagcagcctccatgggcacacaggagggctggtgcctgctgctctgcctggctctatctggagcagcagaaaccatggacctggtccagattccccaggccgaggccttgctccatgctgactgcagtgggaaggaggtgacctgtgagatctcccgctactttctccagatgacagagaccactgttaagacagcagcttggttcatggccaacgtgcaggtctctggagggggacctagcatctccttggtgatgaagactcccagggtcgccaagaatgaggcgctctggcacccgacgctgaacttgccactgagcccccaggggactgtgcgaactgcagtggagttccaggtgatgacacagacccaatccctgagcttcctgctggggtcctcagcctccttggactgtggcttctccatggcaccgggcttggacctcatcagtgtggagtggcgactgcagcacaagggcaggggacgaggggacctacatttgccagatcaccacctctctgtaccgagctcagcagatcatccagctcaacatccaagcttcccctaaagtacgactgagcttggcaaacgaagctctgctgcccaccctcatctgcgacattgctggctattaccctctggatgtggtggtgacgtggacccgagaggagctgggtggatccccagcccaagtctctggtgcctccttctccagcctcaggcaaagcgtggcaggcacctacagcatctcctcctctctcaccgcagaacctggctctgcaggtgccacttacacctgccaggtcacacacatctctctggaggagccccttggggccagcacccaggttgtcccaccagagcggagaacagccttgggagtcatctttgccagcagtctcttccttcttgcactgatgttcctggggcttcagagacggcaagcacctacaggacttgggctgcttcaggctgaacgctgggagaccacttcctgtgctgacacacagagctcccatctccatgaagaccgcacagcgcgtgtaagccagcccagctgacctaaagcgacatgagactactagaaagaaacgacacccttccccaagcccccacagctactccaacccaaacaacaaccaagccagtttaatggtaggaatttgtattttttgcctttgttcagaatacatgacattggtaaatatgccacatgcctttggtggaagtacaactgttgttattactctatacaagtatgagatcagggttaggaaaaaaagacaaagaggtgatgacagacacacagtggaaaccccacatcgtctcatggcaaaccgaagaacgggatgtgggaagctcagcttcatttgactgcaaagtcccagggttttgttgcacatttgctcatgcacatgggtggtgggaggaaagggggatagcaaagacacacagaagagggtacagggtgggtgagaaagaaagtagaagggctaatacccccaaagaacaaggccaactacacctggtgagcctcagagggacagaaacccaggaatgattcctgtgatagggctgggagagccaagaggacggattcgctccaggcttgggacacatcgaggacagtggtggttcttctccagcggtgaccccctgcattaggcaaggaggagcccagaggagagtggagaccttcgaggggggccgttgggagggtactgactgctttcttccagctcttcagtcccgcccttgggcaggacgaagggaatgtgggaaacaagggcgaagggaaaggaaggatggttttgagcaatgaaatgctgctgcatggaaagtgggcatccagaccctgcccagcatggcctcagcctcttcctgttcgtggaccgagggaagaaggaataaagggccatgggcattctccgctctgctcccagcctgccctcctccccttgcacctgggcttatcccacattaatagcccatcctgaagctcagcaattgccccgaagataggctgagcagatcccatcctcaggttccactgtctatacacacaaaccatgcaaagaggaggaagagaaaggaggcaaagtagaattcagacaggaaagggtggttcaaaggggaatatactacaggaagaacagagaggcggctctcaaggagagggccccatgacagcacagcaatacacaagcacacctgacacaggctggcacgcctccccccaaggtggggctggtgggtctacatgacttctctgcatcctgaggatcggccgggccccaggaagaaccacttgcctcatccctgtctttggcaagtgcacgggtggtgtggaggaaaggattccatgggtgtccaaagatctcacactgctaacaccctcacgctccttcatcaacaggaagagaggaacaggaccctctttaacgagggcaaggagtggcttcctctgagcttgttactttcaaattaagcacttgactcactgtttctctataactaacaggcaatctctctctttatgccaacaattaactgggagctaggttaaattatttggctagataaaactaccagctagatggatttatttggtgccctcatacagaatgctgtagaaaatgtaaagaagagaaagctccttccagctagaagcacatgggactgcttctaggatggaaacaagtcctgctattttcacaatccctaagtgttctccaggcctctggagaacaaagtaaagttgtaagatccccaaagacacggaaaatcctggacgaacagattagaaataactacaaaaaacaagttttta

SEQ ID NO: 354701 - DNA, 2756 bp, Homo sapiens
agaaagaaagagtagtcacgtgctcccagaaggactctaagtcaagtcacagagctaaaaatacatgaaggtggcaccagctcatggggcactgggcctggctctgcagaggcctctgccttccttcactgtgcaccctgggctcatgcaccaaggcagagaacaggaagaagtgaggggacaagaagaaggcagaatgtccagatggaggataagaccaaagagccaggttggtggtgtgacggtaggaaaacaaagctggaggaaatggagaaggaacaagtgagggacaatgaggcatgggttggggctgggctacccctcccaaactcagctctgtcaaaataaaaggcccttgtgtctgctgcgaccaagcttttccactttcctgtctttctccacactggtcccaactgagccctgtcaccaagcctagcggctccaacttgcaaagtgtttaagtatgaaacaaaggccctcagaggcacccccgtggctccatctcagttgcacctcagctgcaattagggttctgctccctcgggtgactgctgggaggttcaggatacctgcaaatgcctcactccctcagctgcaaggagagacttctcctttttattcgtttctaaaatgtgcctaatcaatacggtggaactcagcataccaaaactgtacgtgaggatgatggggaaaagggggtaagggggtgttcactgacagccttatctgggcacatcccctgggacaggacaagcaggccaaggacctaggaaggagcacaggaggcagatggaagaggcctgagggaacctgtgcttgtttgccagtgtgagatgcccacgcaacttcctgtcttcacttcctcttaccacacctacaggacttgggctgcttcaggctgaacgctgggagaccacttcctgtgctgacacacagagctcccatctccatgaagaccgcacagcgcgtgtaagccagcccagctgacctaaagcgacatgagactactagaaagaaacgacacccttccccaagcccccacagctactccaacccaaacaacaaccaagccagtttaatggtaggaatttgtattttttgcctttgttcagaatacatgacattggtaaatatgccacatgcctttggtggaagtacaactgttgttattactctatacaagtatgagatcagggttaggaaaaaaagacaaagaggtgatgacagacacacagtggaaaccccacatcgtctcatggcaaaccgaagaacgggatgtgggaagctcagcttcatttgactgcaaagtcccagggttttgttgcacatttgctcatgcacatgggtggtgggaggaaagggggatagcaaagacacacagaagagggtacagggtgggtgagaaagaaagtagaagggctaatacccccaaagaacaaggccaactacacctggtgagcctcagagggacagaaacccaggaatgattcctgtgatagggctgggagagccaagaggacggattcgctccaggcttgggacacatcgaggacagtggtggttcttctccagcggtgaccccctgcattaggcaaggaggagcccagaggagagtggagaccttcgaggggggccgttgggagggtactgactgctttcttccagctcttcagtcccgcccttgggcaggacgaagggaatgtgggaaacaagggcgaagggaaaggaaggatggttttgagcaatgaaatgctgctgcatggaaagtgggcatccagaccctgcccagcatggcctcagcctcttcctgttcgtggaccgagggaagaaggaataaagggccatgggcattctccgctctgctcccagcctgccctcctccccttgcacctgggcttatcccacattaatagcccatcctgaagctcagcaattgccccgaagataggctgagcagatcccatcctcaggttccactgtctatacacacaaaccatgcaaagaggaggaagagaaaggaggcaaagtagaattcagacaggaaagggtggttcaaaggggaatatactacaggaagaacagagaggcggctctcaaggagagggccccatgacagcacagcaatacacaagcacacctgacacaggctggcacgcctccccccaaggtggggctggtgggtctacatgacttctctgcatcctgaggatcggccgggccccaggaagaaccacttgcctcatccctgtctttggcaagtgcacgggtggtgtggaggaaaggattccatgggtgtccaaagatctcacactgctaacaccctcacgctccttcatcaacaggaagagaggaacaggaccctctttaacgagggcaaggagtggcttcctctgagcttgttactttcaaattaagcacttgactcactgtttctctataactaacaggcaatctctctctttatgccaacaattaactgggagctaggttaaattatttggctagataaaactaccagctagatggatttatttggtgccctcatacagaatgctgtagaaaatgtaaagaagagaaagctccttccagctagaagcacatgggactgcttctaggatggaaacaagtcctgctattttcacaatccctaagtgttctccaggcctctggagaacaaagtaaagttgtaagatccccaaagacacggaaaatcctggacgaacagattagaaataactacaaaaaacaagttttta

SEQ ID NO: 354702 - DNA, 1845 bp, Homo sapiens
accacacaagaagcttccacactttctgtctcttagaacggctaaaggcagggtcccctgcccatccgcaggctgacctaaagcgacatgagactactagaaagaaacgacacccttccccaagcccccacagctactccaacccaaacaacaaccaagccagtttaatggtaggaatttgtattttttgcctttgttcagaatacatgacattggtaaatatgccacatgcctttggtggaagtacaactgttgttattactctatacaagtatgagatcagggttaggaaaaaaagacaaagaggtgatgacagacacacagtggaaaccccacatcgtctcatggcaaaccgaagaacgggatgtgggaagctcagcttcatttgactgcaaagtcccagggttttgttgcacatttgctcatgcacatgggtggtgggaggaaagggggatagcaaagacacacagaagagggtacagggtgggtgagaaagaaagtagaagggctaatacccccaaagaacaaggccaactacacctggtgagcctcagagggacagaaacccaggaatgattcctgtgatagggctgggagagccaagaggacggattcgctccaggcttgggacacatcgaggacagtggtggttcttctccagcggtgaccccctgcattaggcaaggaggagcccagaggagagtggagaccttcgaggggggccgttgggagggtactgactgctttcttccagctcttcagtcccgcccttgggcaggacgaagggaatgtgggaaacaagggcgaagggaaaggaaggatggttttgagcaatgaaatgctgctgcatggaaagtgggcatccagaccctgcccagcatggcctcagcctcttcctgttcgtggaccgagggaagaaggaataaagggccatgggcattctccgctctgctcccagcctgccctcctccccttgcacctgggcttatcccacattaatagcccatcctgaagctcagcaattgccccgaagataggctgagcagatcccatcctcaggttccactgtctatacacacaaaccatgcaaagaggaggaagagaaaggaggcaaagtagaattcagacaggaaagggtggttcaaaggggaatatactacaggaagaacagagaggcggctctcaaggagagggccccatgacagcacagcaatacacaagcacacctgacacaggctggcacgcctccccccaaggtggggctggtgggtctacatgacttctctgcatcctgaggatcggccgggccccaggaagaaccacttgcctcatccctgtctttggcaagtgcacgggtggtgtggaggaaaggattccatgggtgtccaaagatctcacactgctaacaccctcacgctccttcatcaacaggaagagaggaacaggaccctctttaacgagggcaaggagtggcttcctctgagcttgttactttcaaattaagcacttgactcactgtttctctataactaacaggcaatctctctctttatgccaacaattaactgggagctaggttaaattatttggctagataaaactaccagctagatggatttatttggtgccctcatacagaatgctgtagaaaatgtaaagaagagaaagctccttccagctagaagcacatgggactgcttctaggatggaaacaagtcctgctattttcacaatccctaagtgttctccaggcctctggagaacaaagtaaagttgtaagatccccaaagacacggaaaatcctggacgaacagattagaaataactacaaaaaacaagttttta

SEQ ID NO: 354703 - DNA, 628 bp, Homo sapiens
gaccaccctgcagctctccagcttcctctctgaaatcccagtcccaaaatccagtttcctggccgcctcctggctcagagccccacccagcagaggggcagtggcgggcagtggacgtggtcctagactgtttcctggcgaaggacggtgcgcaccgtggagctctcaccgcagaacctggctctgcaggtgccacttacacctgccaggtcacacacatctctctggaggagccccttggggccagcacccaggttgtcccaccagagcggagaacagccttgggagtcatctttgccagcagtctcttccttcttgcactgatgttcctggggcttcagagacggcaagcacctacaggacttgggctgcttcaggctgaacgctgggagaccacttcctgtgctgacacacagagctcccatctccatgaagaccgcacagcgcgtgtaagccagcccagctgacctaaagcgacatgagactactagaaagaaacgacacccttccccaagcccccacagctactccaacccaaacaacaaccaagccagtttaatggtaggaatttgtattttttgcctttgttcagaatacatgacattggtaaatatgccacatgcctttg

SEQ ID NO: 354704 - DNA, 1148 bp, Homo sapiens
agaaagaaagagtagtcacgtgctcccagaaggactctaagtcaagtcacagagctaaaaatacatgaaggtggcaccagctcatggggcactgggcctggctctgcagaggcctctgccttccttcactgtgcaccctgggctcatgcaccaaggcagagaacaggaagaagtgaggggacaagaagaaggcagaatgtccagatggaggataagaccaaagagccaggttggtggtgtgacggtaggaaaacaaagctggaggaaatggagaaggaacaagtgagggacaatgaggcatgggttggggctgggctacccctcccaaactcagctctgtcaaaataaaaggcccttgtgtctgctgcgaccaagcttttccactttcctgtctttctccacactggtcccaactgagccctgtcaccaagcctagcggctccaacttgcaaagtgtttaagtatgaaacaaaggccctcagaggcacccccgtggctccatctcagttgcacctcagctgcaattagggttctgctccctcgggtgactgctgggaggttcaggatacctgcaaatgcctcactccctcagctgcaaggagagacttctcctttttattcgtttctaaaatgtgcctaatcaatacggtggaactcagcataccaaaactgtacgtgaggatgatggggaaaagggggtaagggggtgttcactgacagccttatctgggcacatcccctgggacaggacaagcaggccaaggacctaggaaggagcacaggaggcagatggaagaggcctgagggaacctgtgcttgtttgccagtgtgagatgcccacgcaacttcctgtcttcacttcctcttaccacacctacaggacttgggctgcttcaggctgaacgctgggagaccacttcctgtgctgacacacagagctcccatctccatgaagaccgcacagcgcgtgtaagccagcccagctgacctaaagcgacatgagactactagaaagaaacgacacccttccccaagcccccacagctactccaacccaaacaacaaccaagccagtttaatggtaggaatttgtattttttgcctttgttcagaatacatgacattggtaaatatgccacatgcctttg

SEQ ID NO: 354705 - DNA, 952 bp, Homo sapiens
agaaagaaagagtagtcacgtgctcccagaaggactctaagtcaagtcacagagctaaaaatacatgaaggtggcaccagctcatggggcactgggcctggctctgcagaggcctctgccttccttcactgtgcaccctgggctcatgcaccaaggcagagaacaggaagaagtgaggggacaagaagaaggcagaatgtccagatggaggataagaccaaagagccaggttggtggtgtgacggtaggaaaacaaagctggaggaaatggagaaggaacaagtgagggacaatgaggcatgggttggggctgggctacccctcccaaactcagctctgtcaaaataaaaggcccttgtgtctgctgcgaccaagcttttccactttcctgtctttctccacactggtcccaactgagccctgtcaccaagcctagcggctccaacttgcaaagtgtttaagtatgaaacaaaggccctcagaggcacccccgtggctccatctcagttgcacctcagctgcaattagggttctgctccctcgggtgactgctgggaggttcaggatacctgcaaatgcctcactccctcagctgcaaggagagacttctcctttttattcgtttctaaaatgtgcctaatcaatacggtggaactcagcataccaaaactgtacgtgaggatgatggggaaaagggggtaagggggtgttcactgacagccttatctgggcacatcccctgggacaggacaagcaggccaaggacctaggaaggagcacaggaggcagatggaagaggcctgagggaacctgtgcttgtttgccagtgtgagatgcccacgcaacttcctgtcttcacttcctcttaccaacctacggatgctctggctacgtggagaccctctctgacaccgagctcatctccctggccaccgcgcgtgtacccgccgct

SEQ ID NO: 354706 - DNA, 892 bp, Homo sapiens
agaaagaaagagtagtcacgtgctcccagaaggactctaagtcaagtcacagagctaaaaatacatgaaggtggcaccagctcatggggcactgggcctggctctgcagaggcctctgccttccttcactgtgcaccctgggctcatgcaccaaggcagagaacaggaagaagtgaggggacaagaagaaggcagaatgtccagatggaggataagaccaaagagccaggttggtggtgtgacggtaggaaaacaaagctggaggaaatggagaaggaacaagtgagggacaatgaggcatgggttggggctgggctacccctcccaaactcagctctgtcaaaataaaaggcccttgtgtctgctgcgaccaagcttttccactttcctgtctttctccacactggtcccaactgagccctgtcaccaagcctagcggctccaacttgcaaagtgtttaagtatgaaacaaaggccctcagaggcacccccgtggctccatctcagttgcacctcagctgcaattagggttctgctccctcgggtgactgctgggaggttcaggatacctgcaaatgcctcactccctcagctgcaaggagagacttctcctttttattcgtttctaaaatgtgcctaatcaatacggtggaactcagcataccaaaactgtacgtgaggatgatggggaaaagggggtaagggggtgttctttattttctcacatggggactttattggtgtgagcattctggtcattgtcctttttatgagcactggtagttagtgtataatgccttatggaaccttttcttgtttccagtgtgtaattcccactctaacttatgttatttttttactttttccatctacatcatgtctttttcctgtt

SEQ ID NO: 354707 - DNA, 315 bp, Homo sapiens
gacgtggacccgagaggagctgggtggatccccagcccaagtctctggtgcctccttctccagcctcaggcaaagcgtggcaggcacctacagcatctcctcctctctcaccgcagaacctggctctgcaggtgccacttacacctgccaggtcacacacatctctctggaggagccccttggggccagcacccaggttgtcccaccaggtactgggagtgtcctccttttccccacctccacactagggctcatggctctcctgccccagctcatctatggccttgttctgctgcccatccactttgttcgcag

SEQ ID NO: 354708 - DNA, 1749 bp, Homo sapiens
tgccatcttgctctaagtgaaagtgaaagaaaagtcggcagcagagggaacagggaagaaacctaaaggctgcaggctgccaggtgtgcttggagagcccccttcttccgccgggcctcgcaagcagcgtaggactgtggagaagggcggtgggcaaggagggaactcgagagcagcctccatgggcacacaggagggctggtgcctgctgctctgcctggctctatctggagcagcagaaaccaagccccacccagcagaggggcagtggcgggcagtggacgtggtcctagactgtttcctggcgaaggacggtgcgcaccgtggagctctcgccagcagtgaggacagggcaagggcctcccttgtgctgaagcaggtgccagtgctggacgatggctccctggaggacttcaccgatttccaagggggcacactggcccaagatgacccacctattatctttgaggcctcagtggacctggtccagattccccaggccgaggccttgctccatgctgactgcagtgggaaggaggtgacctgtgagatctcccgctactttctccagatgacagagaccactgttaagacagcagcttggttcatggccaacgtgcaggtctctggagggggacctagcatctccttggtgatgaagactcccagggtcgccaagaatgaggcgctctggcacccgacgctgaacttgccactgagcccccaggggactgtgcgaactgcagtggagttccaggtgatgacacagacccaatccctgagcttcctgctggggtcctcagcctccttggactgtggcttctccatggcaccgggcttggacctcatcagtgtggagtggcgactgcagcacaagggcaggggtcagttggtgtacagctggaccgcagggcaggggcaggctgtgcggaagggcgctaccctggagcctgcacaactgggcatggccagggatgcctccctcaccctgcccggcctcactatacaggacgaggggacctacatttgccagatcaccacctctctgtaccgagctcagcagatcatccagctcaacatccaagcttcccctaaagtacgactgagcttggcaaacgaagctctgctgcccaccctcatctgcgacattgctggctattaccctctggatgtggtggtgacgtggacccgagaggagctgggtggatccccagcccaagtctctggtgcctccttctccagcctcaggcaaagcgtggcaggcacctacagcatctcctcctctctcaccgcagaacctggctctgcaggtgccacttacacctgccaggtcacacacatctctctggaggagccccttggggccagcacccaggttgtcccaccagagcggagaacagccttgggagtcatctttgccagcagtctcttccttcttgcactgatgttcctggggcttcagagacggcaagcacctacaggacttgggctgcttcaggctgaacgctgggagaccacttcctgtgctgacacacagagctcccatctccatgaagaccgcacagcgcgtgtaagccagcccagctgacctaaagcgacatgagactactagaaagaaacgacacccttccccaagcccccacagctactccaacccaaacaacaaccaagccagtttaatggtaggaatttgtattttttgcctttgttcagaatacatgacattggtaaatatgccacatgcctttg

SEQ ID NO: 354709 - DNA, 600 bp, Homo sapiens
aaggactcacatgcatcctcaccccaaaccacttaaacaattatgattaggctatacaaaactagaatggattcttgctccttggcaatctgaagtagggagacaaaccatagaggcaagaagtaaaagatgaaagactctgcaacaacatttggatggggttcagggacatccaggatggcatcaagacatctcatctggggctatcctttgactcaactcaaacaagtcctctgccatgatggctacagggacatatggcctagccttgtcctaaatggcatttccccgctgatatggtttggctgtgtccccacccaaatctcaacttcaattgtatcacccagaattcccacatgttgtgggagggactcaggggaggtaactgaatcatggggcccatctttccggtgctattctggtgatagtgacgaagtctcatgagatctgatgggtttatcagtggtttctgcttttgcttcttccacattttctcttgctgctgccatgtaagaagtgcctttcacctgccgccatgattctgaggccttcccagccatgtggaactgtaagtccaattaaacctctttttcttcccag

SEQ ID NO: 354710 - DNA, 3190 bp, Homo sapiens
gaccaccctgcagctctccagcttcctctctgaaatcccagtcccaaaatccagtttcctggccgcctcctggctcagagccccacccagcagaggggcagtggcgggcagtggacgtggtcctagactgtttcctggcgaaggacggtgcgcaccgtggagctctcgccagcagtgaggacagggcaagggcctcccttgtgctgaagcaggtgccagtgctggacgatggctccctggaggacttcaccgatttccaagggggcacactggcccaagatgacccacctattatctttgaggcctcagtggacctggtccagattccccaggccgaggccttgctccatgctgactgcagtgggaaggaggtgacctgtgagatctcccgctactttctccagatgacagagaccactgttaagacagcagcttggttcatggccaacgtgcaggtctctggagggggacctagcatctccttggtgatgaagactcccagggtcgccaagaatgaggcgctctggcacccgacgctgaacttgccactgagcccccaggggactgtgcgaactgcagtggagttccaggtgatgacacagacccaatccctgagcttcctgctggggtcctcagcctccttggactgtggcttctccatggcaccgggcttggacctcatcagtgtggagtggcgactgcagcacaagggcaggggtcagttggtgtacagctggaccgcagggcaggggcaggctgtgcggaagggcgctaccctggagcctgcacaactgggcatggccagggatgcctccctcaccctgcccggcctcactatacaggacgaggggacctacatttgccagatcaccacctctctgtaccgagctcagcagatcatccagctcaacatccaagcttcccctaaagtacgactgagcttggcaaacgaagctctgctgcccaccctcatctgcgacattgctggctattaccctctggatgtggtggtgacgtggacccgagaggagctgggtggatccccagcccaagtctctggtgcctccttctccagcctcaggcaaagcgtggcaggcacctacagcatctcctcctctctcaccgcagaacctggctctgcaggtgccacttacacctgccaggtcacacacatctctctggaggagccccttggggccagcacccaggttgtcccaccagagcggagaacagccttgggagtcatctttgccagcagtctcttccttcttgcactgatgttcctggggcttcagagacggcaagcacctacaggacttgggctgcttcaggctgaacgctgggagaccacttcctgtgctgacacacagagctcccatctccatgaagaccgcacagcgcgtgtaagccagcccagctgacctaaagcgacatgagactactagaaagaaacgacacccttccccaagcccccacagctactccaacccaaacaacaaccaagccagtttaatggtaggaatttgtattttttgcctttgttcagaatacatgacattggtaaatatgccacatgcctttggtggaagtacaactgttgttattactctatacaagtatgagatcagggttaggaaaaaaagacaaagaggtgatgacagacacacagtggaaaccccacatcgtctcatggcaaaccgaagaacgggatgtgggaagctcagcttcatttgactgcaaagtcccagggttttgttgcacatttgctcatgcacatgggtggtgggaggaaagggggatagcaaagacacacagaagagggtacagggtgggtgagaaagaaagtagaagggctaatacccccaaagaacaaggccaactacacctggtgagcctcagagggacagaaacccaggaatgattcctgtgatagggctgggagagccaagaggacggattcgctccaggcttgggacacatcgaggacagtggtggttcttctccagcggtgaccccctgcattaggcaaggaggagcccagaggagagtggagaccttcgaggggggccgttgggagggtactgactgctttcttccagctcttcagtcccgcccttgggcaggacgaagggaatgtgggaaacaagggcgaagggaaaggaaggatggttttgagcaatgaaatgctgctgcatggaaagtgggcatccagaccctgcccagcatggcctcagcctcttcctgttcgtggaccgagggaagaaggaataaagggccatgggcattctccgctctgctcccagcctgccctcctccccttgcacctgggcttatcccacattaatagcccatcctgaagctcagcaattgccccgaagataggctgagcagatcccatcctcaggttccactgtctatacacacaaaccatgcaaagaggaggaagagaaaggaggcaaagtagaattcagacaggaaagggtggttcaaaggggaatatactacaggaagaacagagaggcggctctcaaggagagggccccatgacagcacagcaatacacaagcacacctgacacaggctggcacgcctccccccaaggtggggctggtgggtctacatgacttctctgcatcctgaggatcggccgggccccaggaagaaccacttgcctcatccctgtctttggcaagtgcacgggtggtgtggaggaaaggattccatgggtgtccaaagatctcacactgctaacaccctcacgctccttcatcaacaggaagagaggaacaggaccctctttaacgagggcaaggagtggcttcctctgagcttgttactttcaaattaagcacttgactcactgtttctctataactaacaggcaatctctctctttatgccaacaattaactgggagctaggttaaattatttggctagataaaactaccagctagatggatttatttggtgccctcatacagaatgctgtagaaaatgtaaagaagagaaagctccttccagctagaagcacatgggactgcttctaggatggaaacaagtcctgctattttcacaatccctaagtgttctccaggcctctggagaacaaagtaaagttgtaagatccccaaagacacggaaaatcctggacgaacagattagaaataactacaaaaaacaagttttta

SEQ ID NO: 354711 - DNA, 3001 bp, Homo sapiens
tggtaacaccaagtgacttgtcaaaggtcacggagccagtaagtggaacaaccagggtttcagagctttttctgctactctagtagttcttacctgaagattgatggtaactcttaattttgcatgtgtatttttcctggtgggagatccatagctttcactaaattatcctagagtaagtgatcccaaaatggtgatggccatcatgtgtaccatgctacctttccagagccccatttctttgtggttccatgtgatggaaaataagctcaaccggcctgtcaggcgaggaagaggcaggtgtatgcccacaacatgcccacagcttggagatcaggtgacctcaaggaggaagtagcccacaaatcacccctcttttcctcttcacagtggagttccaggtgatgacacagacccaatccctgagcttcctgctggggtcctcagcctccttggactgtggcttctccatggcaccgggcttggacctcatcagtgtggagtggcgactgcagcacaagggcaggggtcagttggtgtacagctggaccgcagggcaggggcaggctgtgcggaagggcgctaccctggagcctgcacaactgggcatggccagggatgcctccctcaccctgcccggcctcactatacaggacgaggggacctacatttgccagatcaccacctctctgtaccgagctcagcagatcatccagctcaacatccaagcttcccctaaagtacgactgagcttggcaaacgaagctctgctgcccaccctcatctgcgacattgctggctattaccctctggatgtggtggtgacgtggacccgagaggagctgggtggatccccagcccaagtctctggtgcctccttctccagcctcaggcaaagcgtggcaggcacctacagcatctcctcctctctcaccgcagaacctggctctgcaggtgccacttacacctgccaggtcacacacatctctctggaggagccccttggggccagcacccaggttgtcccaccagagcggagaacagccttgggagtcatctttgccagcagtctcttccttcttgcactgatgttcctggggcttcagagacggcaagcacctacaggacttgggctgcttcaggctgaacgctgggagaccacttcctgtgctgacacacagagctcccatctccatgaagaccgcacagcgcgtgtaagccagcccagctgacctaaagcgacatgagactactagaaagaaacgacacccttccccaagcccccacagctactccaacccaaacaacaaccaagccagtttaatggtaggaatttgtattttttgcctttgttcagaatacatgacattggtaaatatgccacatgcctttggtggaagtacaactgttgttattactctatacaagtatgagatcagggttaggaaaaaaagacaaagaggtgatgacagacacacagtggaaaccccacatcgtctcatggcaaaccgaagaacgggatgtgggaagctcagcttcatttgactgcaaagtcccagggttttgttgcacatttgctcatgcacatgggtggtgggaggaaagggggatagcaaagacacacagaagagggtacagggtgggtgagaaagaaagtagaagggctaatacccccaaagaacaaggccaactacacctggtgagcctcagagggacagaaacccaggaatgattcctgtgatagggctgggagagccaagaggacggattcgctccaggcttgggacacatcgaggacagtggtggttcttctccagcggtgaccccctgcattaggcaaggaggagcccagaggagagtggagaccttcgaggggggccgttgggagggtactgactgctttcttccagctcttcagtcccgcccttgggcaggacgaagggaatgtgggaaacaagggcgaagggaaaggaaggatggttttgagcaatgaaatgctgctgcatggaaagtgggcatccagaccctgcccagcatggcctcagcctcttcctgttcgtggaccgagggaagaaggaataaagggccatgggcattctccgctctgctcccagcctgccctcctccccttgcacctgggcttatcccacattaatagcccatcctgaagctcagcaattgccccgaagataggctgagcagatcccatcctcaggttccactgtctatacacacaaaccatgcaaagaggaggaagagaaaggaggcaaagtagaattcagacaggaaagggtggttcaaaggggaatatactacaggaagaacagagaggcggctctcaaggagagggccccatgacagcacagcaatacacaagcacacctgacacaggctggcacgcctccccccaaggtggggctggtgggtctacatgacttctctgcatcctgaggatcggccgggccccaggaagaaccacttgcctcatccctgtctttggcaagtgcacgggtggtgtggaggaaaggattccatgggtgtccaaagatctcacactgctaacaccctcacgctccttcatcaacaggaagagaggaacaggaccctctttaacgagggcaaggagtggcttcctctgagcttgttactttcaaattaagcacttgactcactgtttctctataactaacaggcaatctctctctttatgccaacaattaactgggagctaggttaaattatttggctagataaaactaccagctagatggatttatttggtgccctcatacagaatgctgtagaaaatgtaaagaagagaaagctccttccagctagaagcacatgggactgcttctaggatggaaacaagtcctgctattttcacaatccctaagtgttctccaggcctctggagaacaaagtaaagttgtaagatccccaaagacacggaaaatcctggacgaacagattagaaataactacaaaaaacaagttttta

SEQ ID NO: 354712 - DNA, 1768 bp, Homo sapiens
tgccatcttgctctaagtgaaagtgaaagaaaagtcggcagcagagggaacagggaagaaacctaaaggctgcaggctgccaggtgtgcttggagagcccccttcttccgccgggcctcgcaagcagcgtaggactgtggagaagggcggtgggcaaggagggaactcgagagcagcctccatgggcacacaggagggctggtgcctgctgctctgcctggctctatctggagcagcagaaaccaagccccacccagcagaggggcagtggcgggcagtggacgtggtcctagactgtttcctggcgaaggacggtgcgcaccgtggagctctcgccagcagtgaggacagggcaagggcctcccttgtgctgaagcaggtgccagtgctggacgatggctccctggaggacttcaccgatttccaagggggcacactggcccaagatgacccacctattatctttgaggcctcagtggacctggtccagattccccaggccgaggccttgctccatgctgactgcagtgggaaggaggtgacctgtgagatctcccgctactttctccagatgacagagaccactgttaagacagcagcttggttcatggccaacgtgcaggtctctggagggggacctagcatctccttggtgatgaagactcccagggtcgccaagaatgaggcgctctggcacccgacgctgaacttgccactgagcccccaggggactgtgcgaactgcagtggagttccaggtgatgacacagacccaatccctgagcttcctgctggggtcctcagcctccttggactgtggcttctccatggcaccgggcttggacctcatcagtgtggagtggcgactgcagcacaagggcaggggtcagttggtgtacagctggaccgcagggcaggggcaggctgtgcggaagggcgctaccctggagcctgcacaactgggcatggccagggatgcctccctcaccctgcccggcctcactatacaggacgaggggacctacatttgccagatcaccacctctctgtaccgagctcagcagatcatccagctcaacatccaagcttcccctaaagtacgactgagcttggcaaacgaagctctgctgcccaccctcatctgcgacattgctggctattaccctctggatgtggtggtgacgtggacccgagaggagctgggtggatccccagcccaagtctctggtgcctccttctccagcctcaggcaaagcgtggcaggcacctacagcatctcctcctctctcaccgcagaacctggctctgcaggtgccacttacacctgccaggtcacacacatctctctggaggagccccttggggccagcacccaggttgtcccaccagagcggagaacagccttgggagtcatctttgccagcagtctcttccttcttgcactgatgttcctggggcttcagagacggcaagcacctacaggacttgggctgcttcaggctgaacgctgggagaccacttcctgtgctgacacacagagctcccatctccatgaagaccgcacagcgcgtgtaagccagcccagctgacctaaagcgacatgagactactagaaagaaacgacacccttccccaagcccccacagctactccaacccaaacaacaaccaagccagtttaatgaagtgcctttcacctgccgccatgattctgaggccttcccagccatgtggaactgtaagtccaattaaacctctttttcttcccag

SEQ ID NO: 354713 - DNA, 474 bp, Homo sapiens
tttgactgaaaagatagtcttttattcaacagttggaaatgcaagcataaactcctctgagcaaggcaaatccaggactttaactctcaccaagaagtatttgcctggactagcaggtgctctccagaaagctggtttggggatgacgggagaatagagggacacagaaacagctaggatcttggatggcaacttttaccctttgatgactccacagcttgagggcgggggcaggaagcaagtgtggagtagctttctggggaaggcggtgctcaccccagcctttgtctgcagagagccccacccagcagaggggcagtggcgggcagtggacgtggtcctagactgtttcctggcgaaggacggtgcgcaccgtggagctctcgccagcagtgaggacagggcaagggcctcccttgtgctgaagcaggtgccagtgctggacgatggctccctggaggacttcaccgattt

SEQ ID NO: 354714 - DNA, 1528 bp, Homo sapiens
ctgatggctgttctcctagtccccaagagttgaaccggagaggcttttactttgcaccaggtcgagaacgtgatcagccctttagagaaggaacctccttgtaacaggaattctgctgggaaacgccgtgtaggcactacctccgaagataagatgcatgtttggagctgtgtaaaatgcccactggctgtttgaaagaaggaaaaggtgactagggttgcaaattaaccttagtatcacttaaaaatattctatctagtcaaatgtacgtaagcaaagaagagagcaccaggatataaaactgccacagcagcttggaagacagatgattcagattttggggactttcttttgcgtgttacatagatttgtttgtcatcatgcagttaagcaggtgttgagggaaagctgagagaatgaaggctctaaatccccagtggaagcatgatatggcgaagcagagctggtgctgaattgttctctctgatggctctatgggagtggatagcactgagtcttcattgctgggttttagcggttgctgctgtttcggatcagcatgccacaagccccttcgactggctcctctctgataagggacccttccatcgctcacaggaatacacagattttgtggacagaagccggcagggatttagcacaagatacaagatatacagggagtttggccgctggaaagtaaataaccttgcagttgagagaagaaatttccttggctctcctctgcctcttgcccctgaattcttccgcaacataagacttttgggacgtcgacctacccttcagcaaatcacagaaaaccttatcaagaaatatgggacacatttcttgctatctgctactctgggaggagaggagtcactcacaatttttgtggacaagcggaagttgagcaaacgagctgaaggaagtgattccaccaccaatagctcttcggtcactctggagacgctacatcagctagccgcttcttatttcattgacagggacagcacccttcggagacttcaccacattcaaattgcatccactgccataaaggtaacagaaacacggactggtcctcttggctgcagtaactatgacaacctagattctgtcagttctgttctggttcagagtcctgagaataagattcagttgcaagggcttcaagtacttctcccagactatcttcaggaacgttttgtacaagcagctttgagctacattgcttgcaattcagagggagagtttatctgcaaggaaaatgactgctggtgtcactgtggtcccaaatttccagaatgcaactgcccctccatggacattcaagccatggaagagaatcttcttcgaataactgaaacctggaaagcttacaacagtgactttgaggaatcaggcttgaaattcaaatcctgttatactctacatagacaataaaaattggaatggagttttaggttactttcaaaggctgattcaatgtaatgtgaaaaattaaacaaatgcaagtaaataactt

SEQ ID NO: 354715 - DNA, 200 bp, Homo sapiens
catcagctagccgcttcttatttcattgacagggacagcacccttcggagacttcaccacattcaaattgcatccactgccataaaggtaagaatgagtttacgctaaaattatcaccttccattgtttgtttcctctatatccaaaaggcatttttatgtatttgcttattccatgaatttaaacaattattttataaa

SEQ ID NO: 354716 - DNA, 2236 bp, Homo sapiens
ctgatggctgttctcctagtccccaagagttgaaccggagaggcttttactttgcaccaggtcgagaacgtgatcagccctttagagaaggaacctccttgtaacaggaattctgctgggaaacgccgtgtaggcactacctccgaagataagatgcatgtttggagctgtgtaaaatgcccactggctgtttgaaagaaggaaaaggtgactagggttgcaaattaaccttagtatcacttaaaaatattctatctagtcaaatgtacgtaagcaaagaagagagcaccaggatataaaactgccacagcagcttggaagacagatgattcagattttggggactttcttttgcgtgttacatagatttgtttgtcatcatgcagttaagcaggtgttgagggaaagctgagagaatgaaggctctaaatccccagtggaagcatgatatggcgaagcagagctggtgctgaattgttctctctgatggctctatgggagtggatagcactgagtcttcattgctgggttttagcggttgctgctgtttcggatcagcatgccacaagccccttcgactggctcctctctgataagggacccttccatcgctcacaggaatacacagattttgtggacagaagccggcagggatttagcacaagatacaagatatacagggagtttggccgctggaaagtaaataaccttgcagttgagagaagaaatttccttggctctcctctgcctcttgcccctgaattcttccgcaacataagacttttgggacgtcgacctacccttcagcaaatcacagaaaaccttatcaagaaatatgggacacatttcttgctatctgctactctgggaggagaggagtcactcacaatttttgtggacaagcggaagttgagcaaacgagctgaaggaagtgattccaccaccaatagctcttcggtcactctggagacgctacatcagctagccgcttcttatttcattgacagggacagcacccttcggagacttcaccacattcaaattgcatccactgccataaaggtaacagaaacacggactggtcctcttggctgcagtaactatgacaacctagattctgtcagttctgttctggttcagagtcctgagaataagattcagttgcaagggcttcaagtacttctcccagactatcttcaggaacgttttgtacaagcagctttgagctacattgcttgcaattcagagggagagtttatctgcaaggaaaatgactgctggtgtcactgtggtcccaaatttccagaatgcaactgcccctccatggacattcaagccatggaagagaatcttcttcgaataactgaaacctggaaagcttacaacagtgactttgaggaatcagatgaattcaagttatttatgaaaaggctacctatgaattatttcctcaacacatctactataatgcatttgtggacaatggattctaattttcagcgccgttatgaacaactggagaacagcatgaaacaacttttcctaaaggcgcagaaaattgtacacaagctttttagccttagcaagaggtgtcataaacaacccctcatcagcctgccaagacaaagaacctcaacctactggcttactcgcatccagtcttttctctactgcaatgagaacggcctcctaggcagcttttcagaagagacgcactcgtgcacgtgtccgaatgaccaggtggtctgcaccgcgttcctgccctgcacagtgggagacgcctctgcctgcctgacatgcgcaccagacaaccgcacccgctgcggcacctgcaacaccggctacatgctcagccaggggctctgcaagcctgaagtcgccgagtccaccgatcactatattggctttgaaactgacctgcaagatctcgagatgaaatatctgctgcagaaaacggacagacgaatagaagtccatgccatttttatcagcaatgacatgcgcctcaatagctggtttgatccctcctggcgtaagcggatgctcctcaccttgaagagcaataagtgcaagtcaagtctggtccatatgattttgggtctctctttacagatttgcttaactaaaaacagcaccttggagccagtgttggctgtttatgtcaatcccttcggaggcagccactctgagagctggtttatgcctgtgaatgaaaacagctttccagactgggagc

SEQ ID NO: 354717 - DNA, 2024 bp, Homo sapiens
ttcgtggctctctgtgtaactggtttttacttggttacatgccaccaggaactgctgattattttaaagtcctactaccctgcagctcactactttaccttgatttggaagatcatggaatatctatttgaatcctggatgtatttttctcacagtcttcttgcttcctgaaatttcctctggtgttgagggaaagctgagagaatgaaggctctaaatccccagtggaagcatgatatggcgaagcagagctggtgctgaattgttctctctgatggctctatgggagtggatagcactgagtcttcattgctgggttttagcggttgctgctgtttcggatcagcatgccacaagccccttcgactggctcctctctgataagggacccttccatcgctcacaggaatacacagattttgtggacagaagccggcagggatttagcacaagatacaagatatacagggagtttggccgctggaaagtaaataaccttgcagttgagagaagaaatttccttggctctcctctgcctcttgcccctgaattcttccgcaacataagacttttgggacgtcgacctacccttcagcaaatcacagaaaaccttatcaagaaatatgggacacatttcttgctatctgctactctgggaggagaggagtcactcacaatttttgtggacaagcggaagttgagcaaacgagctgaaggaagtgattccaccaccaatagctcttcggtcactctggagacgctacatcagctagccgcttcttatttcattgacagggacagcacccttcggagacttcaccacattcaaattgcatccactgccataaaggtaacagaaacacggactggtcctcttggctgcagtaactatgacaacctagattctgtcagttctgttctggttcagagtcctgagaataagattcagttgcaagggcttcaagtacttctcccagactatcttcaggaacgttttgtacaagcagctttgagctacattgcttgcaattcagagggagagtttatctgcaaggaaaatgactgctggtgtcactgtggtcccaaatttccagaatgcaactgcccctccatggacattcaagccatggaagagaatcttcttcgaataactgaaacctggaaagcttacaacagtgactttgaggaatcagatgaattcaagttatttatgaaaaggctacctatgaattatttcctcaacacatctactataatgcatttgtggacaatggattctaattttcagcgccgttatgaacaactggagaacagcatgaaacaacttttcctaaaggcgcagaaaattgtacacaagctttttagccttagcaagaggtgtcataaacaacccctcatcagcctgccaagacaaagaacctcaacctactggcttactcgcatccagtcttttctctactgcaatgagaacggcctcctaggcagcttttcagaagagacgcactcgtgcacgtgtccgaatgaccaggtggtctgcaccgcgttcctgccctgcacagtgggagacgcctctgcctgcctgacatgcgcaccagacaaccgcacccgctgcggcacctgcaacaccggctacatgctcagccaggggctctgcaagcctgaagtcgccgagtccaccgatcactatattggctttgaaactgacctgcaagatctcgagatgaaatatctgctgcagaaaacggacagacgaatagaagtccatgccatttttatcagcaatgacatgcgcctcaatagctggtttgatccctcctggcgtaagcggatgctcctcaccttgaagagcaataagtgcaagtcaagtctggtccatatgattttgggtctctctttacagatttgcttaactaaaaacagcaccttggagccagtgttggctgtttatgtcaatcccttcggaggcagccactctgagagctggtttatgcctgtgaatgaaaacagctttccagactgggagc

SEQ ID NO: 354718 - DNA, 397 bp, Homo sapiens
tccgggagactctgcagatgtatttttatccaccaacaaacgggatttgctagaaagaaggagcttgggtgaatggaagagtaaaaatgaagtacaactatgaagttacagaattattcccagtctttaaaaatcttcaaaacttcacttcgttcagaacttccaattatacagaagaggctgtcaactccattaacaaagcttttttttcctttcactggatttcaaaccactggctacagtgagttctgctgccacatcctgggtcatcgattctgccattggtgtcctaggacagcattaagaccttcagctgtcttctgattgaggacaagatcatggtgtctcatcgtccccaccccactgtaattcaaaataaaaacaatgctaaaccaca

SEQ ID NO: 354719 - DNA, 577 bp, Homo sapiens
cagagtctgcaaattactttcccagactccatgctactgagtgcaagcgtgtgacccaagttctatggctgggattttcccatagactccagttaaaaacaaacaacataaacaacatgaaccaagacgagctgccagtgtctgctggggcaagggtgacggagagagacctccgaagcttggagggtgctgtggccaggttcctggtggtcgagccctgtactcagcgagaatggtagttagttactcaggcatcctggacagagatggctgaaacagacaccctcgcaggagtggcctgcactttaatttgagcatcgattcaggacgcttccttgcaagatggagtctccatctcccgagattccatgagctacctagcagtgtttaacacactccttttctgattcagctggctacagtgagttctgctgccacatcctgggtcatcgattctgccattggtgtcctaggacagcattaagaccttcagctgtcttctgattgaggacaagatcatggtgtctcatcgtccccaccccactgtaattcaaaataaaaacaatgctaaaccaca

SEQ ID NO: 354720 - DNA, 3194 bp, Homo sapiens
ggcacgagctaggactgatctccaggaccagcactcttctcccagcccttagggtcctgctcggccaaggccttccctgccatgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcacgctgcaggctgcccacatcctctgccgggagctgggcttcacagaggccacaggctggacccacagtgccaaatatggccctggaacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggtagagcatcacctgcaagtggaggaggtgcgaattcgacccgccgttgggtggggcagacgacccctgcccgtgacggaggggctggtggaagtcaggcttcctgacggctggtcgcaagtgtgcgacaaaggctggagcgcccacaacagccacgtggtctgcgggatgctgggcttccccagcgaaaagagggtcaacgcggccttctacaggctgctagcccaacggcagcaacactcctttggtctgcatggggtggcgtgcgtgggcacggaggcccacctctccctctgttccctggagttctatcgtgccaatgacaccgccaggtgccctggggggggccctgcagtggtgagctgtgtgccaggccctgtctacgcggcatccagtggccagaagaagcaacaacagtcgaagcctcagggggaggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcagggcatgggtgctatccacctgagtgaagttcgctgctctggacaggagctctccctctggaagtgcccccacaagaacatcacagctgaggattgttcacatagccaggatgccggggtccggtgcaacctaccttacactggggcagagaccaggatccgactcagtgggggccgcagccaacatgaggggcgagtcgaggtgcaaatagggggacctgggccccttcgctggggcctcatctgtggggatgactgggggaccctggaggccatggtggcctgtaggcaactgggtctgggctacgccaaccacggcctgcaggagacctggtactgggactctgggaatataacagaggtggtgatgagtggagtgcgctgcacagggactgagctgtccctggatcagtgtgcccatcatggcacccacatcacctgcaagaggacagggacccgcttcactgctggagtcatctgttctgagactgcatcagatctgttgctgcactcagcactggtgcaggagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctgggcgccactcctgggtgtggcacgagtgccatgggcattaccacagcatggacatcttcactcactatgatatcctcaccccaaatggcaccaaggtggctgagggccacaaagctagtttctgtctcgaagacactgagtgtcaggaggatgtctccaagcggtatgagtgtgccaactttggagagcaaggcatcactgtgggttgctgggatctctaccggcatgacattgactgtcagtggattgacatcacggatgtgaagccaggaaactacattctccaggttgtcatcaacccaaactttgaagtagcagagagtgactttaccaacaatgcaatgaaatgtaactgcaaatatgatggacatagaatctgggtgcacaactgccacattggtgatgccttcagtgaagaggccaacaggaggtttgaacgctaccctggccagaccagcaaccagattatctaagtgccactgccctctgcaaaccaccactggcccctaatggcaggggtctgaggctgccattacctcaggagcttaccaagaaacccatgtcagcaaccgcactcatcagaccatgcactatggatgtggaactgtcaagcagaagttttcaccctccttcagaggccagctgtcagtatctgtagccaagcatgggaatctttgctcccaggcccagcaccgagcagaacagaccagagcccaccacaccacaaagagcagcacctgactaactgcccacaaaagatggcagcagctcattttctttaataggaggtcaggatggtcagctccagtatctcccctaagtttagggggatacagctttacctctagccttttggtgggggaaaagatccagccctcccacctcattttttactataatatgttgctaggtataattttattttatataaaaagtgtttctgtgattcttcagagcccaggagtcagtgctggtggttggagggacctgcccccactggttcatttaaccctctgtctcggtgccctcagaacctcagccagaaaggcaaggaggaaatcagagcaggagcctcatactcttggtgatctattcattctgtgacctcaggggtcacatataaggtcagtgtttctcgtccccgccggatctgcactgccaactgggattgggttcgaacagcttcataaacatcttcagcattttgtaccatctgctccccaatggccaaaatcacatcaccaggccgcagaccagcccgtgtgcaggggagcccaggatgactttatggatgagtacaccatgctgaacatcgggaaagctt

SEQ ID NO: 354721 - DNA, 477 bp, Homo sapiens
tattagccaaacccaggcattctccccatcctgagttccacctcaagtctctcatcaacacattgataaatatatggacaggacatgggctaggtactacaaaatacaatggcaactcactttctgtcttctagcaataaagtgcaacatgtacataaaagatgtacaccacatgagggcaccaaatgacaaacagtgttaaatcaatagcactaatgtcattctagaatactaagagaagctttaaggggaaagaacttaagttgagcctaaaaggatggatctgatattaaccatataaaacaagaacagcataaataaaaaacatgggagtaggaaatcaggttggctgagtattcatataggaaggtattacagccaggtctagaaagttgatttacagacagatggaaaatggcccttaaatgccaagttaatggattgaaggcttgaaatcaaagcagtaacaggatgaaa

SEQ ID NO: 354722 - DNA, 3413 bp, Homo sapiens
ggcacgagctaggactgatctccaggaccagcactcttctcccagcccttagggtcctgctcggccaaggtagggggagtcacgctaaccgcagagggaatgagtaggggatggagaggatgtggagggaccagggaaaacgggtggtgtgggatggagtcgaggggaagccacccaactgagagtttgatttcttgtcaatccctctccttctcacccgcggtgtgcttggttcccctatactgagtgcttagttctttgcctatcactttctatccgttgtctctctcctctgtgtctttctggttttctctctctcattcccacagtctcccttcctctcacatcctgtctgtctgggtcttcctctctctctacgtgtctcttgctcagtctctatctctttttattgacccttctctgactctcgatctctcatagtgtctcttatctctgggtctctcaggctgtgcctctatgacctgtgcctcagcccttatttaatgtgtttctctccctgtctcttggtccctggggctctttctctcctgttgtctctcgctgtctctgtcttactcagtgtctgtttttctttcgtgacttctccctctctttctgactctgggccccactcaatctgtttctctcacgcacactttgtctctggggcacccaggccttccctgccatgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcacgctgcaggctgcccacatcctctgccgggagctgggcttcacagaggccacaggctggacccacagtgccaaatatggccctggaacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggtagagcatcacctgcaagtggaggaggtgcgaattcgacccgccgttgggtggggcagacgacccctgcccgtgacggaggggctggtggaagtcaggcttcctgacggctggtcgcaagtgtgcgacaaaggctggagcgcccacaacagccacgtggtctgcgggatgctgggcttccccagcgaaaagagggtcaacgcggccttctacaggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcagggcatgggtgctatccacctgagtgaagttcgctgctctggacaggagctctccctctggaagtgcccccacaagaacatcacagctgaggattgttcacatagccaggatgccggggtccggtgcaacctaccttacactggggcagagaccagggagacctggtactgggactctgggaatataacagaggtggtgatgagtggagtgcgctgcacagggactgagctgtccctggatcagtgtgcccatcatggcacccacatcacctgcaagaggacagggacccgcttcactgctggagtcatctgttctgagactgcatcagatctgttgctgcactcagcactggtgcaggagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctgggcgccactcctgggtgtggcacgagtgccatgggcattaccacagcatggacatcttcactcactatgatatcctcaccccaaatggcaccaaggtggctgagggccacaaagctagtttctgtctcgaagacactgagtgtcaggaggatgtctccaagcggtatgagtgtgccaactttggagagcaaggcatcactgtgggttgctgggatctctaccggcatgacattgactgtcagtggattgacatcacggatgtgaagccaggaaactacattctccaggttgtcatcaacccaaactttgaagtagcagagagtgactttaccaacaatgcaatgaaatgtaactgcaaatatgatggacatagaatctgggtgcacaactgccacattggtgatgccttcagtgaagaggccaacaggaggtttgaacgctaccctggccagaccagcaaccagattatctaagtgccactgccctctgcaaaccaccactggcccctaatggcaggggtctgaggctgccattacctcaggagcttaccaagaaacccatgtcagcaaccgcactcatcagaccatgcactatggatgtggaactgtcaagcagaagttttcaccctccttcagaggccagctgtcagtatctgtagccaagcatgggaatctttgctcccaggcccagcaccgagcagaacagaccagagcccaccacaccacaaagagcagcacctgactaactgcccacaaaagatggcagcagctcattttctttaataggaggtcaggatggtcagctccagtatctcccctaagtttagggggatacagctttacctctagccttttggtgggggaaaagatccagccctcccacctcattttttactataatatgttgctaggtataattttattttatataaaaagtgtttctgtgattcttcagagcccaggagtcagtgctggtggttggagggacctgcccccactggttcatttaaccctctgtctcggtgccctcagaacctcagccagaaaggcaaggaggaaatcagagcaggagcctcatactcttggtgatctattcattctgtgacctcaggggtcacatataaggtcagtgtttctcgtccccgccggatctgcactgccaactgggattgggttcgaacagcttcataaacatcttcagcattttgtaccatctgctccccaatggccaaaatcacatcaccaggccgcagaccagcccgtgtgcaggggagcccaggatgactttatggatgagtacaccatgctgaacatcgggaaagctt

SEQ ID NO: 354723 - DNA, 3318 bp, Homo sapiens
ggcacgagctaggactgatctccaggaccagcactcttctcccagcccttagggtcctgctcggccaaggtagggggagtcacgctaaccgcagagggaatgagtaggggatggagaggatgtggagggaccagggaaaacgggtggtgtgggatggagtcgaggggaagccacccaactgagagtttgatttcttgtcaatccctctccttctcacccgcggtgtgcttggttcccctatactgagtgcttagttctttgcctatcactttctatccgttgtctctctcctctgtgtctttctggttttctctctctcattcccacagtctcccttcctctcacatcctgtctgtctgggtcttcctctctctctacgtgtctcttgctcagtctctatctctttttattgacccttctctgactctcgatctctcatagtgtctcttatctctgggtctctcaggctgtgcctctatgacctgtgcctcagcccttatttaatgtgtttctctccctgtctcttggtccctggggctctttctctcctgttgtctctcgctgtctctgtcttactcagtgtctgtttttctttcgtgacttctccctctctttctgactctgggccccactcaatctgtttctctcacgcacactttgtctctggggcacccaggccttccctgccatgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcacgctgcaggctgcccacatcctctgccgggagctgggcttcacagaggccacaggctggacccacagtgccaaatatggccctggaacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggtagagcatcacctgcaagtggaggaggtgcgaattcgacccgccgttgggtggggcagacgacccctgcccgtgacggaggggctggtggaagtcaggcttcctgacggctggtcgcaagtgtgcgacaaaggctggagcgcccacaacagccacgtggtctgcgggatgctgggcttccccagcgaaaagagggtcaacgcggccttctacaggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcagggcatgggtgctatccacctgagtgaagttcgctgctctggacaggagctctccctctggaagtgcccccacaagaacatcacagctgaggattgttcacatagccaggatgccggggtccggtgcaacctaccttacactggggcagagaccagggagacctggtactgggactctgggaatataacagaggtggtgatgagtggagtgcgctgcacagggactgagctgtccctggatcagtgtgcccatcatggcacccacatcacctgcaagaggacagggacccgcttcactgctggagtcatctgttctgagactgcatcagatctgttgctgcactcagcactggtgcaggagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctgggcgccactcctgggtgtggcacgagtgccatgggcattaccacagcatggacatcttcactcactatgatatcctcaccccaaatggcaccaaggtggctgagggccacaaagctagtttctgtctcgaagacactgagtgtcaggaggatgtctccaagcggtatgagtgtgccaactttggagagcaaggcatcactgtgggttgctgggatctctaccggcatgacattgactgtcagtggattgacatcacggatgtgaagccaggaaactacattctccaggttgtcatcaacccaaactttgaagtagcagagagtgactttaccaacaatgcaatgaaatgtaactgcaaatatgatggacatagaatctgggtgcacaactgccacattgcaccactggcccctaatggcaggggtctgaggctgccattacctcaggagcttaccaagaaacccatgtcagcaaccgcactcatcagaccatgcactatggatgtggaactgtcaagcagaagttttcaccctccttcagaggccagctgtcagtatctgtagccaagcatgggaatctttgctcccaggcccagcaccgagcagaacagaccagagcccaccacaccacaaagagcagcacctgactaactgcccacaaaagatggcagcagctcattttctttaataggaggtcaggatggtcagctccagtatctcccctaagtttagggggatacagctttacctctagccttttggtgggggaaaagatccagccctcccacctcattttttactataatatgttgctaggtataattttattttatataaaaagtgtttctgtgattcttcagagcccaggagtcagtgctggtggttggagggacctgcccccactggttcatttaaccctctgtctcggtgccctcagaacctcagccagaaaggcaaggaggaaatcagagcaggagcctcatactcttggtgatctattcattctgtgacctcaggggtcacatataaggtcagtgtttctcgtccccgccggatctgcactgccaactgggattgggttcgaacagcttcataaacatcttcagcattttgtaccatctgctccccaatggccaaaatcacatcaccaggccgcagaccagcccgtgtgcaggggagcccaggatgactttatggatgagtacaccatgctgaacatcgggaaagctt

SEQ ID NO: 354724 - DNA, 1053 bp, Homo sapiens
  misc_feature (591)..(591): n is a, c, g, or t
  misc_feature (603)..(603): n is a, c, g, or t
  misc_feature (607)..(607): n is a, c, g, or t
  misc_feature (614)..(614): n is a, c, g, or t
  misc_feature (627)..(627): n is a, c, g, or t
cccccttttgtttcttcttagtcgcgccctcgctgattaaatatagttttgcatcaactagatattatcgcttctgtgttcctcagtctttttttctgactcgccacgggccttaaatatagcgctcgctttgtttcacacccccgtcttagtcaaggctttctcaaaaattagtgaatatattatccccccagtcgagtggttctatttatatttctcttctgtgttggaagagggtgttggtgtcgcccccaatgtgtcttcgctcttgcccgccgatacagaaagtggctctcctctctccacaaaagaacttcccacgtgtacagcgtgttgtttcgtccccttctcctactgtttgtttaatatacgcgcgcgcgctccgcgcgctgctccgtgcatctgtataataaactataccctacctccctctcctatgtatgaggggcgcgccgcccgtttgctctactataaattcgtggggtgcgtgttggggcgccccccccggggaggagagttatttttgtcgccgcgcgccgcccctctttttttttttttttttttttttttttttttttttttttttttttntttttttttttntttnttttttnttttttttttttntttttttgctaggtataattttattttatataaaaagtgtttctgtgattcttcagagcccaggagtcagtgctggtggttggagggacctgcccccactggttcatttaaccctctgtctcggtgccctcagaacctcagccagaaaggcaaggaggaaatcagagcaggagcctcatactcttggtgatctattcattctgtgacctcaggggtcacatataaggtcagtgtttctcgtccccgccggatctgcactgccaactgggattgggttcgaacagcttcataaacatcttcagcattttgtaccatctgctccccaatggccaaaatcacatcaccaggccgcagaccagcccgtgtgcaggggagcccaggatgactttatggatgagtacaccatgctgaacatcgggaaagctt

SEQ ID NO: 354725 - DNA, 1828 bp, Homo sapiens
agtgggaaggaaaggggagccgaggctgttgtctcaaagcctgtgttttgggcagagggctgaggaatgagtccctttggccccagatgctggatcctgggccttacagaaacatctgcatatgtccccaggagacctggtactgggactctgggaatataacagaggtggtgatgagtggagtgcgctgcacagggactgagctgtccctggatcagtgtgcccatcatggcacccacatcacctgcaagaggacagggacccgcttcactgctggagtcatctgttctgagactgcatcagatctgttgctgcactcagcactggtgcaggagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctgggcgccactcctgggtgtggcacgagtgccatgggcattaccacagcatggacatcttcactcactatgatatcctcaccccaaatggcaccaaggtggctgagggccacaaagctagtttctgtctcgaagacactgagtgtcaggaggatgtctccaagcggtatgagtgtgccaactttggagagcaaggcatcactgtgggttgctgggatctctaccggcatgacattgactgtcagtggattgacatcacggatgtgaagccaggaaactacattctccaggttgtcatcaacccaaactttgaagtagcagagagtgactttaccaacaatgcaatgaaatgtaactgcaaatatgatggacatagaatctgggtgcacaactgccacattggtgatgccttcagtgaagaggccaacaggaggtttgaacgctaccctggccagaccagcaaccagattatctaagtgccactgccctctgcaaaccaccactggcccctaatggcaggggtctgaggctgccattacctcaggagcttaccaagaaacccatgtcagcaaccgcactcatcagaccatgcactatggatgtggaactgtcaagcagaagttttcaccctccttcagaggccagctgtcagtatctgtagccaagcatgggaatctttgctcccaggcccagcaccgagcagaacagaccagagcccaccacaccacaaagagcagcacctgactaactgcccacaaaagatggcagcagctcattttctttaataggaggtcaggatggtcagctccagtatctcccctaagtttagggggatacagctttacctctagccttttggtgggggaaaagatccagccctcccacctcattttttactataatatgttgctaggtataattttattttatataaaaagtgtttctgtgattcttcagagcccaggagtcagtgctggtggttggagggacctgcccccactggttcatttaaccctctgtctcggtgccctcagaacctcagccagaaaggcaaggaggaaatcagagcaggagcctcatactcttggtgatctattcattctgtgacctcaggggtcacatataaggtcagtgtttctcgtccccgccggatctgcactgccaactgggattgggttcgaacagcttcataaacatcttcagcattttgtaccatctgctccccaatggccaaaatcacatcaccaggccgcagaccagcccgtgtgcaggggagcccaggatgactttatggatgagtacaccatgctgaacatcgggaaagctt

SEQ ID NO: 354726 - DNA, 406 bp, Homo sapiens
aatcacatcaccaggccgcagaccagccctatagagaaaaatggacagagagaaaggaaggagtacaaagcctagttcaaggacacatgcacaccttgcccatccccatatcacactgcagcctctccctcaccgtgtgcaggggagcccaggatgactttatggatgagtacaccatgctgaacatcgggaaagcttggttctcgaagctgtagttcagcaaggatgctgaaagtacacagatcaccctattagccaaacccaggcattctccccatcctgagttccacctcaagtctctcatcaacacattgataaatatatggacaggacatgggctaggtactacaaaatacaatggcaactcactttctgtcttctagcaataaagtgcaacatgtacata

SEQ ID NO: 354727 - DNA, 6890 bp, Homo sapiens
acccgccccggctactccaacccctgggcgggcgggggtaccgcctgggcaagggccggggcgccgggccgagccacctcttcccctcccccgcttccctgtcgcgctccgctggctggacgcgctggaggagtggagcagcacccggccggccctgggggctgacagtcggcaaagtttggcccgaagaggaagtggtctcaaaccccggcaggtggcgaccaggccagaccaggggcgctcgctgcctgcgggcgggctgtaggcgagggcgcgccccagtgccgagacccggggcttcaggagccggccccgggagagaagagtgcggcggcggacggagaaaacaactccaaagttggcgaaaggcaccgcccctactcccgggctgccgccgcctccccgcccccagccctggcatccagagtacgggtcgagcccgggccatggagcccccctggggaggcggcaccagggagcctgggcgcccggggctccgccgcgaccccatcgggtagaccacagaagctccgggacccttccggcacctctggacagcccaggatgctgttggccaccctcctcctcctcctccttggaggcgctctggcccatccagaccggattatttttccaaatcatgcttgtgaggaccccccagcagtgctcttagaagtgcagggcaccttacagaggcccctggtccgggacagccgcacctcccctgccaactgcacctggctcatcctgggcagcaaggaacagactgtcaccatcaggttccagaagctacacctggcctgtggctcagagcgcttaaccctacgctcccctctccagccactgatctccctgtgtgaggcacctcccagccctctgcagctgcccgggggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctggtacgccgtctccgccgctggggcttgctccctcgaaccaacaccccggctcgggcctctgaggccagatcccaggtcacaccttctgctgctccccttgaggccctagatggtggcacaggtccagcccgtgagggcggggcagtgggtgggcaagatggggagcaggcacccccactgcccatcaaggctcccctcccatctgctagcacgtctccagcccccactactgtccctgaagccccagggccactgccctcactgcccctagagccatcactattgtctggagtggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtgggcctcccgttgaccctatgtagctgctataaagttaagtgtccctcaggcagggagagggctcacagagtctcctctgtacgtggccatggccagacaccccagtcccttcaccaccacctgctccccacgccaccaccatttgggtggctgtttttaaaaagtaaagttcttagaggatcataggtctggacactccatccttgccaaacctctacccaaaagtggccttaagcaccggaatgccaattaactagagaccctccagcccccaaggggaggatttgggcagaacctgaggttttgccatccacaatccctcctacagggcctggctcacaaaaagagtgcaacaaatgcttctattccatagctacggcattgctcagtaagttgaggtcaaaaataaaggaatcatacatctcaaaattttgcaaattagctgcgagcctgagccccgcctctgcccatctcagtctatgctcacctcatcccactcctccctgtggagccctttgcttggccctctacctcctgccctcttcctgttcatctcccaaccactgcactcttgatttttataccacacagaaggtaagaaaattctaggaaccctaaggatcaatcctctccattttcactcaaatgcctggggcccagctctgcaatgactgactccagggcctctttcctcactgccagcatagaagtcaggggagccagctgggccctgcggtcaggaaggttctcatttttggagcattccctgagcccagatcataggagcagctgtccctggtgggacacaggagtcatgactcctaccctccaccctccacacccaccaggcatttagcagtctgtcctatgcaagacagatgaattctcagccaggatacctcaaggcaggcaaaggtgagtggagggaaaattcacaaacattcagggtgtgtggtgctggcatcaccatggccaaatccaagaggtcttcctggaagagggcccaaactggaaccaaaagaatgctgtcagcagttggaatagagctgtgaattctagacagggggagtgtccccagaacaagcaaacggaggagacaagagggcaagggttataggaaagaccctgggcctgagagcacaagcagcggccagagctgcagcgctggggtgggtgatggagggaatgattcgcaagcagtgttggaacccagcccctagtgagcaaagtgacagaagctgccccagagtttggaaggaagatcgaggcagaagatgtagaaggaagctgtgggggtgggagtgatgcctcaggaacaaaactgaggaattccctaacggacccagtccctggggaaagaggctcccctcaggctctccttgtctagccccacacctggcagagcctgtcacccagcctagccccacgcctggcagagcccatcacccagcctagccccacacctggtggagaggccctgttgattacaccctgtcagcctcctcaaacccagcactaattgcacaattttcctctcttctagtgagcaagagcctgaggaagtagcagagaggggtgtgggcccatgtgcagttctgggaccctggcaccttggctcagggaagacccgagctcctttcactgcagaccctctccagagactggggagagggctctggagaacctggttcttgcttactgttctccctttgggccctccttcccaaacgcaaacaatccaggatccactcagcgtcaggcccaatggaaatagtgaagcagtgattttccctcccctgcctctccatagcctggtcttttgccctctcctttgctcttctcttcccccatagccacctcaaatacctgcagcctgatatcttcatcccttcatccagaccttttctctcctagtggtattgcaaactgaaagtggacaaagacttaaggtaaacctgctcctcatggtggaatgcttccaaatgctggaaggaggactttagggcagagttcactaaggaggcttgtgcttatagatcagtgggcctgaaagaagtttctctaggttctggttgtgtgctgtacgaggtgtaggtagtaataatactcttgtcagccacagtgaagccccaagctagccgggataggggactgaccttgtacaggcagcatggagaaactaagacagagtgtcctgcccaagtgatggcactggggagcagtcactcaggtttatttccaccagggcccaagaaaaaaagaaatgaggcaacctaaaattccatcaagatagataccaatatccaaggtgcttggtcttagcggtgtgggacccacgttaaggctcttggtgggaaggtgggaggtgttttcagcatgagatagggttcaggctgtgaatcagagtctagagcctaagataaaagaagataccagggctgggccacggtggctttcgcctgtaatcctagcactttgggaggccaaggcaggcagactgcctgagctcaggagttcgagactagcctgagcaacacggtgaaaccctgtctctactaaaatacaaaaaagtagccaggtgtggcggcatgcacctgtagtcccagctactcgagaggctgaggcaggagaattgcttgaacccgggaggcggaggttgcagtgagtggagatcgcgccactgcactctagcctgggtgacagagcgagactccttctccaaaaaaaaagaaaagaagataccagaactcagtccttaagaaacaaaattctgccaggcgcagtagctcacacctgtaatcccagcactttggaggggccaaggcaggcggatcgcttgaggccaagagttcaagaacagcctgggcaacatgatgaaaccctgtctctaccaaaaatactaaaaattagccagtctcacaacctggtctcaaaataaataaatagatttaaaaaaaaaatcatgggcctgaaccaagctccagacctcactaggaggggagaaggaccccccagccacacagcccaaggctgcagaagcacctaggtggttagagagtgagtgcctggatggggcgcagtggctcacacctgtaatcccagcactttgggaggccgaggcaggcggatcacgaggtcaagagatcaagaccatcctggccaacatggtgacaccgtgtctctactaaaaatacaaaaataagctgggcatggtggtgcgtgcctgtagtcccatctactcgggaggctgaagcaggagaatcacttgaacctgggaggcaaaggttgcagtgagctgagatcgcgccactgcactccagcctggcaacagagcgagacaagactccatcttcaaaaaaaaaagtgagtgcccgatgatgccagattcttcatcacctgaagtgaacccacacaacagggctgggccatgggcatcataaaccccattttgcaagctcaggaggagctttagggaaatcagaagactggcccagtctctaccaagtggtggatttagagccggcatggcttcgttccaaatctcacccttgtcccaccattccatgggacctcccattcctgagggagcctggatacgggcaagtgcacaacccgggaggttgaggttacagtgagccatgatcgcaccactgcagtccagcccgagcaatagggtgagaccctccctctgaaaaaaataaaaatactcattttggaaggaagtcattctaaaatgttacacttgtcttcagcatatctgcaatataataattttctgcataactgaggatcattcacagaaaccaatggcttttctccagcagtgtcttctgaagttgtaacagtaggggcacggggagctatttgcttttatgctaaatgaccttagaccacttataaaatgcatatgagtgctttaaatgttattttgtgtgtgtgtggtgttgcctccctgactacaaggggtcacttgctactctaaatgtgtttctaatctactagtacaggaacacacatggacacgttaaaattgtgaataaaagtaagtaaaaagta

SEQ ID NO: 354728 - DNA, 6751 bp, Homo sapiens
acccgccccggctactccaacccctgggcgggcgggggtaccgcctgggcaagggccggggcgccgggccgagccacctcttcccctcccccgcttccctgtcgcgctccgctggctggacgcgctggaggagtggagcagcacccggccggccctgggggctgacagtcggcaaagtttggcccgaagaggaagtggtctcaaaccccggcaggtggcgaccaggccagaccaggggcgctcgctgcctgcgggcgggctgtaggcgagggcgcgccccagtgccgagacccggggcttcaggagccggccccgggagagaagagtgcggcggcggacggagaaaacaactccaaagttggcgaaaggcaccgcccctactcccgggctgccgccgcctccccgcccccagccctggcatccagagtacgggtcgagcccgggccatggagcccccctggggaggcggcaccagggagcctgggcgcccggggctccgccgcgaccccatcgggtagaccacagaagctccgggacccttccggcacctctggacagcccaggatgctgttggccaccctcctcctcctcctccttggaggcgctctggcccatccagaccggattatttttccaaatcatgcttgtgaggaccccccagcagtgctcttagaagtgcagggcaccttacagaggcccctggtccgggacagccgcacctcccctgccaactgcacctggctcatcctgggcagcaaggaacagactgtcaccatcaggttccagaagctacacctggcctgtggctcagagcgcttaaccctacgctcccctctccagccactgatctccctgtgtgaggcacctcccagccctctgcagctgcccgggggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctggtacgccgtctccgccgctggggcttgctccctcgaaccaacaccccggctcgggcctctgaggccagatcccaggtcacaccttctgctgctccccttgaggccctagatggtggcacaggtccagcccgtgagggcggggcagtgggtgggcaagatggggagcaggcacccccactgcccatcaaggctcccctcccatctgctagcacgtctccagcccccactactgtccctgaagccccagggccactgccctcactgcccctagagccatcactattgtctggagtggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtgggcctcccgttgaccctatgtagctgctataaagttaagtgtccctcaggcagggagagggctcacagagtctcctctgtacgtggccatggccagacaccccagtcccttcaccaccacctgctccccacgccaccaccatttgggtggctgtttttaaaaagtaaagttcttagaggatcataggtctggacactccatccttgccaaacctctacccaaaagtggccttaagcaccggaatgccaattaactagagaccctccagcccccaaggggaggatttgggcagaacctgaggttttgccatccacaatccctcctacagggcctggctcacaaaaagagtgcaacaaatgcttctattccatagctacggcattgctcagtaagttgaggtcaaaaataaaggaatcatacatctcaaaattttgcaaattagctgcgagcctgagccccgcctctgcccatctcagtctatgctcacctcatcccactcctccctgtggagccctttgcttggccctctacctcctgccctcttcctgttcatctcccaaccactgcactcttgatttttataccacacagaaggtaagaaaattctaggaaccctaaggatcaatcctctccattttcactcaaatgcctggggcccagctctgcaatgactgactccagggcctctttcctcactgccagcatagaagtcaggggagccagctgggccctgcggtcaggaaggttctcatttttggagcattccctgagcccagatcataggagcagctgtccctggtgggacacaggagtcatgactcctaccctccaccctccacacccaccaggcatttagcagtctgtcctatgcaagacagatgaattctcagccaggatacctcaaggcaggcaaaggtgagtggagggaaaattcacaaacattcagggtgtgtggtgctggcatcaccatggccaaatccaagaggtcttcctggaagagggcccaaactggaaccaaaagaatgctgtcagcagttggaatagagctgtgaattctagacagggggagtgtccccagaacaagcaaacggaggagacaagagggcaagggttataggaaagaccctgggcctgagagcacaagcagcggccagagctgcagcgctggggtgggtgatggagggaatgattcgcaagcagtgttggaacccagcccctagtgagcaaagtgacagaagctgccccagagtttggaaggaagatcgaggcagaagatgtagaaggaagctgtgggggtgggagtgatgcctcaggaacaaaactgaggaattccctaacggacccagtccctggggaaagaggctcccctcaggctctccttgtctagccccacacctggcagagcctgtcacccagcctagccccacgcctggcagagcccatcacccagcctagccccacacctggtggagaggccctgttgattacaccctgtcagcctcctcaaacccagcactaattgcacaattttcctctcttctagtgagcaagagcctgaggaagtagcagagaggggtgtgggcccatgtgcagttctgggaccctggcaccttggctcagggaagacccgagctcctttcactgcagaccctctccagagactggggagagggctctggagaacctggttcttgcttactgttctccctttgggccctccttcccaaacgcaaacaatccaggatccactcagcgtcaggcccaatggaaatagtgaagcagtgattttccctcccctgcctctccatagcctggtcttttgccctctcctttgctcttctcttcccccatagccacctcaaatacctgcagcctgatatcttcatcccttcatccagaccttttctctcctagtggtattgcaaactgaaagtggacaaagacttaaggtaaacctgctcctcatggtggaatgcttccaaatgctggaaggaggactttagggcagagttcactaaggaggcttgtgcttatagatcagtgggcctgaaagaagtttctctaggttctggttgtgtgctgtacgaggtgtaggtagtaataatactcttgtcagccacagtgaagccccaagctagccgggataggggactgaccttgtacaggcagcatggagaaactaagacagagtgtcctgcccaagtgatggcactggggagcagtcactcaggtttatttccaccagggcccaagaaaaaaagaaatgaggcaacctaaaattccatcaagatagataccaatatccaaggtgcttggtcttagcggtgtgggacccacgttaaggctcttggtgggaaggtgggaggtgttttcagcatgagatagggttcaggctgtgaatcagagtctagagcctaagataaaagaagataccagggctgggccacggtggctttcgcctgtaatcctagcactttgggaggccaaggcaggcagactgcctgagctcaggagttcgagactagcctgagcaacacggtgaaaccctgtctctactaaaatacaaaaaagtagccaggtgtggcggcatgcacctgtagtcccagctactcgagaggctgaggcaggagaattgcttgaacccgggaggcggaggttgcagtgagtggagatcgcgccactgcactctagcctgggtgacagagcgagactccttctccaaaaaaaaagaaaagaagataccagaactcagtccttaagaaacaaaattctgccaggcgcagtagctcacacctgtaatcccagcactttggaggggccaaggcaggcggatcgcttgaggccaagagttcaagaacagcctgggcaacatgatgaaaccctgtctctaccaaaaatactaaaaattagccagtctcacaacctggtctcaaaataaataaatagatttaaaaaaaaaatcatgggcctgaaccaagctccagacctcactaggaggggagaaggaccccccagccacacagcccaaggctgcagaagcacctaggtggttagagagtgagtgcctggatggggcgcagtggctcacacctgtaatcccagcactttgggaggccgaggcaggcggatcacgaggtcaagagatcaagaccatcctggccaacatggtgacaccgtgtctctactaaaaatacaaaaataagctgggcatggtggtgcgtgcctgtagtcccatctactcgggaggctgaagcaggagaatcacttgaacctgggaggcaaaggttgcagtgagctgagatcgcgccactgcactccagcctggcaacagagcgagacaagactccatcttcaaaaaaaaaagtgagtgcccgatgatgccagattcttcatcacctgaagtgaacccacacaacagggctgggccatgggcatcataaaccccattttgcaagctcaggaggagctttagggaaatcagaagactggcccagtctctaccaagtggtggatttagagccggcatggcttcgttccaaatctcacccttgtcccaccattccatgggacctcccattcctgagggagcctggatacgggcaagtgcacaacccgggaggttgaggttacagtgagccatgatcgcaccactgcagtccagcccgagcaatagggtgagaccctccctctgaaaaaaataaaaatactcattttggaaggaagtcattctaaaatgttacacttgtcttcagcatatctgcaatataataattttctgcataactgaggatcattcacagaaaccaatggcttttctccagcagtgtcttctgaagttgtaacagtaggggcacggggagctatttgcttttatgctaaatgaccttagaccacttataaaatgcatatgagtgctt

SEQ ID NO: 354729 - DNA, 2607 bp, Homo sapiens
cccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctatgtgagcgctgctacagtgaggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctggtacgccgtctccgccgctggggcttgctccctcgaaccaacaccccggctcgggcctctgaggccagatcccaggtcacaccttctgctgctccccttgaggccctagatggtggcacaggtccagcccgtgagggcggggcagtgggtgggcaagatggggagcaggcacccccactgcccatcaaggctcccctcccatctgctagcacgtctccagcccccactactgtccctgaagccccagggccactgccctcactgcccctagagccatcactattgtctggagtggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtgggcctcccgttgaccctatgtagctgctataaagttaagtgtccctcaggcagggagagggctcacagagtctcctctgtacgtggccatggccagacaccccagtcccttcaccaccacctgctccccacgccaccaccatttgggtggctgtttttaaaaagtaaagttcttagaggatcataggtctggacactccatccttgccaaacctctacccaaaagtggccttaagcaccggaatgccaattaactagagaccctccagcccccaaggggaggatttgggcagaacctgaggttttgccatccacaatccctcctacagggcctggctcacaaaaagagtgcaacaaatgcttctattccatagctacggcattgctcagtaagttgaggtcaaaaataaaggaatcatacatctca

SEQ ID NO: 354730 - DNA, 2229 bp, Homo sapiens
gggacttctatggggtcttctcctctcctggatatacacacctagcctcagtctcccacccccagtcctgcaaggtgacattgcaaggcagggaggggacgggtcttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctggtacgccgtctccgccgctggggcttgctccctcgaaccaacaccccggctcgggcctctgaggccagatcccaggtcacaccttctgctgctccccttgaggccctagatggtggcacaggtccagcccgtgagggcggggcagtgggtgggcaagatggggagcaggcacccccactgcccatcaaggctcccctcccatctgctagcacgtctccagcccccactactgtccctgaagccccagggccactgccctcactgcccctagagccatcactattgtctggagtggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtgggcctcccgttgaccctatgtagctgctataaagttaagtgtccctcaggcagggagagggctcacagagtctcctctgtacgtggccatggccagacaccccagtcccttcaccaccacctgctccccacgccaccaccatttgggtggctgtttttaaaaagtaaagttcttagaggatcataggtctggacactccatccttgccaaacctctacccaaaagtggccttaagcaccggaatgccaattaactagagaccctccagcccccaaggggaggatttgggcagaacctgaggttttgccatccacaatccctcctacagggcctggctcacaaaaagagtgcaacaaatgcttctattccatagctacggcattgctcagtaagttgaggtcaaaaataaaggaatcatacatctca

SEQ ID NO: 354731 - DNA, 5174 bp, Homo sapiens
tgaggctgggctgtgcagctacaggagaccacgaaagtgcccaccttggggagaggctcccatgatcagcttgtcagttgtgtcctgtaagggacaggtccagatcctgaaagcagtttcaagggaggagggacctcagatgacctttgggaaagccatggcacagctccagctggcctggcccgggtgtggaagtgggaggactgtccaggctgaggtggtctactctggccgagaactaccagtgactgagcagtcctcattccttctagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctggtacgccgtctccgccgctggggcttgctccctcgaaccaacaccccggctcgggcctctgaggccagatcccaggtcacaccttctgctgctccccttgaggccctagatggtggcacaggtccagcccgtgagggcggggcagtgggtgggcaagatggggagcaggcacccccactgcccatcaaggctcccctcccatctgctagcacgtctccagcccccactactgtccctgaagccccagggccactgccctcactgcccctagagccatcactattgtctggagtggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtgggcctcccgttgaccctatgtagctgctataaagttaagtgtccctcaggcagggagagggctcacagagtctcctctgtacgtggccatggccagacaccccagtcccttcaccaccacctgctccccacgccaccaccatttgggtggctgtttttaaaaagtaaagttcttagaggatcataggtctggacactccatccttgccaaacctctacccaaaagtggccttaagcaccggaatgccaattaactagagaccctccagcccccaaggggaggatttgggcagaacctgaggttttgccatccacaatccctcctacagggcctggctcacaaaaagagtgcaacaaatgcttctattccatagctacggcattgctcagtaagttgaggtcaaaaataaaggaatcatacatctcaaaattttgcaaattagctgcgagcctgagccccgcctctgcccatctcagtctatgctcacctcatcccactcctccctgtggagccctttgcttggccctctacctcctgccctcttcctgttcatctcccaaccactgcactcttgatttttataccacacagaaggtaagaaaattctaggaaccctaaggatcaatcctctccattttcactcaaatgcctggggcccagctctgcaatgactgactccagggcctctttcctcactgccagcatagaagtcaggggagccagctgggccctgcggtcaggaaggttctcatttttggagcattccctgagcccagatcataggagcagctgtccctggtgggacacaggagtcatgactcctaccctccaccctccacacccaccaggcatttagcagtctgtcctatgcaagacagatgaattctcagccaggatacctcaaggcaggcaaaggtgagtggagggaaaattcacaaacattcagggtgtgtggtgctggcatcaccatggccaaatccaagaggtcttcctggaagagggcccaaactggaaccaaaagaatgctgtcagcagttggaatagagctgtgaattctagacagggggagtgtccccagaacaagcaaacggaggagacaagagggcaagggttataggaaagaccctgggcctgagagcacaagcagcggccagagctgcagcgctggggtgggtgatggagggaatgattcgcaagcagtgttggaacccagcccctagtgagcaaagtgacagaagctgccccagagtttggaaggaagatcgaggcagaagatgtagaaggaagctgtgggggtgggagtgatgcctcaggaacaaaactgaggaattccctaacggacccagtccctggggaaagaggctcccctcaggctctccttgtctagccccacacctggcagagcctgtcacccagcctagccccacgcctggcagagcccatcacccagcctagccccacacctggtggagaggccctgttgattacaccctgtcagcctcctcaaacccagcactaattgcacaattttcctctcttctagtgagcaagagcctgaggaagtagcagagaggggtgtgggcccatgtgcagttctgggaccctggcaccttggctcagggaagacccgagctcctttcactgcagaccctctccagagactggggagagggctctggagaacctggttcttgcttactgttctccctttgggccctccttcccaaacgcaaacaatccaggatccactcagcgtcaggcccaatggaaatagtgaagcagtgattttccctcccctgcctctccatagcctggtcttttgccctctcctttgctcttctcttcccccatagccacctcaaatacctgcagcctgatatcttcatcccttcatccagaccttttctctcctagtggtattgcaaactgaaagtggacaaagacttaaggtaaacctgctcctcatggtggaatgcttccaaatgctggaaggaggactttagggcagagttcactaaggaggcttgtgcttatagatcagtgggcctgaaagaagtttctctaggttctggttgtgtgctgtacgaggtgtaggtagtaataatactcttgtcagccacagtgaagccccaagctagccgggataggggactgaccttgtacaggcagcatggagaaactaagacagagtgtcctgcccaagtgatggcactggggagcagtcactcaggtttatttccaccagggcccaagaaaaaaagaaatgaggcaacctaaaattccatcaagatagataccaatatccaaggtgcttggtcttagcggtgtgggacccacgttaaggctcttggtgggaaggtgggaggtgttttcagcatgagatagggttcaggctgtgaatcagagtctagagcctaagataaaagaagataccagggctgggccacggtggctttcgcctgtaatcctagcactttgggaggccaaggcaggcagactgcctgagctcaggagttcgagactagcctgagcaacacggtgaaaccctgtctctactaaaatacaaaaaagtagccaggtgtggcggcatgcacctgtagtcccagctactcgagaggctgaggcaggagaattgcttgaacccgggaggcggaggttgcagtgagtggagatcgcgccactgcactctagcctgggtgacagagcgagactccttctccaaaaaaaaagaaaagaagataccagaactcagtccttaagaaacaaaattctgccaggcgcagtagctcacacctgtaatcccagcactttggaggggccaaggcaggcggatcgcttgaggccaagagttcaagaacagcctgggcaacatgatgaaaccctgtctctaccaaaaatactaaaaattagccagtctcacaacctggtctcaaaataaataaatagatttaaaaaaaaaatcatgggcctgaaccaagctccagacctcactaggaggggagaaggaccccccagccacacagcccaaggctgcagaagcacctaggtggttagagagtgagtgcctggatggggcgcagtggctcacacctgtaatcccagcactttgggaggccgaggcaggcggatcacgaggtcaagagatcaagaccatcctggccaacatggtgacaccgtgtctctactaaaaatacaaaaataagctgggcatggtggtgcgtgcctgtagtcccatctactcgggaggctgaagcaggagaatcacttgaacctgggaggcaaaggttgcagtgagctgagatcgcgccactgcactccagcctggcaacagagcgagacaagactccatcttcaaaaaaaaaagtgagtgcccgatgatgccagattcttcatcacctgaagtgaacccacacaacagggctgggccatgggcatcataaaccccattttgcaagctcaggaggagctttagggaaatcagaagactggcccagtctctaccaagtggtggatttagagccggcatggcttcgttccaaatctcacccttgtcccaccattccatgggacctcccattcctgagggagcctggatacgggcaagtgcacaacccgggaggttgaggttacagtgagccatgatcgcaccactgcagtccagcccgagcaatagggtgagaccctccctctgaaaaaaataaaaatactcattttggaaggaagtcattctaaaatgttacacttgtcttcagcatatctgcaatataataattttctgcataactgaggatcattcacagaaaccaatggcttttctccagcagtgtcttctgaagttgtaacagtaggggcacggggagctatttgcttttatgctaaatgaccttagaccacttataaaatgcatatgagtgctttaaatgttattttgtgtgtgtgtggtgttgcctccctgactacaaggggtcacttgctactctaaatgtgtttctaatctactagtacaggaacacacatggacacgttaaaattgtgaataaaagtaagtaaaaagta

SEQ ID NO: 354732 - DNA, 4531 bp, Homo sapiens
acccgccccggctactccaacccctgggcgggcgggggtaccgcctgggcaagggccggggcgccgggccgagccacctcttcccgtctccagcccccactactgtccctgaagccccagggccactgccctcactgcccctagagccatcactattgtctggagtggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtgggcctcccgttgaccctatgtagctgctataaagttaagtgtccctcaggcagggagagggctcacagagtctcctctgtacgtggccatggccagacaccccagtcccttcaccaccacctgctccccacgccaccaccatttgggtggctgtttttaaaaagtaaagttcttagaggatcataggtctggacactccatccttgccaaacctctacccaaaagtggccttaagcaccggaatgccaattaactagagaccctccagcccccaaggggaggatttgggcagaacctgaggttttgccatccacaatccctcctacagggcctggctcacaaaaagagtgcaacaaatgcttctattccatagctacggcattgctcagtaagttgaggtcaaaaataaaggaatcatacatctcaaaattttgcaaattagctgcgagcctgagccccgcctctgcccatctcagtctatgctcacctcatcccactcctccctgtggagccctttgcttggccctctacctcctgccctcttcctgttcatctcccaaccactgcactcttgatttttataccacacagaaggtaagaaaattctaggaaccctaaggatcaatcctctccattttcactcaaatgcctggggcccagctctgcaatgactgactccagggcctctttcctcactgccagcatagaagtcaggggagccagctgggccctgcggtcaggaaggttctcatttttggagcattccctgagcccagatcataggagcagctgtccctggtgggacacaggagtcatgactcctaccctccaccctccacacccaccaggcatttagcagtctgtcctatgcaagacagatgaattctcagccaggatacctcaaggcaggcaaaggtgagtggagggaaaattcacaaacattcagggtgtgtggtgctggcatcaccatggccaaatccaagaggtcttcctggaagagggcccaaactggaaccaaaagaatgctgtcagcagttggaatagagctgtgaattctagacagggggagtgtccccagaacaagcaaacggaggagacaagagggcaagggttataggaaagaccctgggcctgagagcacaagcagcggccagagctgcagcgctggggtgggtgatggagggaatgattcgcaagcagtgttggaacccagcccctagtgagcaaagtgacagaagctgccccagagtttggaaggaagatcgaggcagaagatgtagaaggaagctgtgggggtgggagtgatgcctcaggaacaaaactgaggaattccctaacggacccagtccctggggaaagaggctcccctcaggctctccttgtctagccccacacctggcagagcctgtcacccagcctagccccacgcctggcagagcccatcacccagcctagccccacacctggtggagaggccctgttgattacaccctgtcagcctcctcaaacccagcactaattgcacaattttcctctcttctagtgagcaagagcctgaggaagtagcagagaggggtgtgggcccatgtgcagttctgggaccctggcaccttggctcagggaagacccgagctcctttcactgcagaccctctccagagactggggagagggctctggagaacctggttcttgcttactgttctccctttgggccctccttcccaaacgcaaacaatccaggatccactcagcgtcaggcccaatggaaatagtgaagcagtgattttccctcccctgcctctccatagcctggtcttttgccctctcctttgctcttctcttcccccatagccacctcaaatacctgcagcctgatatcttcatcccttcatccagaccttttctctcctagtggtattgcaaactgaaagtggacaaagacttaaggtaaacctgctcctcatggtggaatgcttccaaatgctggaaggaggactttagggcagagttcactaaggaggcttgtgcttatagatcagtgggcctgaaagaagtttctctaggttctggttgtgtgctgtacgaggtgtaggtagtaataatactcttgtcagccacagtgaagccccaagctagccgggataggggactgaccttgtacaggcagcatggagaaactaagacagagtgtcctgcccaagtgatggcactggggagcagtcactcaggtttatttccaccagggcccaagaaaaaaagaaatgaggcaacctaaaattccatcaagatagataccaatatccaaggtgcttggtcttagcggtgtgggacccacgttaaggctcttggtgggaaggtgggaggtgttttcagcatgagatagggttcaggctgtgaatcagagtctagagcctaagataaaagaagataccagggctgggccacggtggctttcgcctgtaatcctagcactttgggaggccaaggcaggcagactgcctgagctcaggagttcgagactagcctgagcaacacggtgaaaccctgtctctactaaaatacaaaaaagtagccaggtgtggcggcatgcacctgtagtcccagctactcgagaggctgaggcaggagaattgcttgaacccgggaggcggaggttgcagtgagtggagatcgcgccactgcactctagcctgggtgacagagcgagactccttctccaaaaaaaaagaaaagaagataccagaactcagtccttaagaaacaaaattctgccaggcgcagtagctcacacctgtaatcccagcactttggaggggccaaggcaggcggatcgcttgaggccaagagttcaagaacagcctgggcaacatgatgaaaccctgtctctaccaaaaatactaaaaattagccagtctcacaacctggtctcaaaataaataaatagatttaaaaaaaaaatcatgggcctgaaccaagctccagacctcactaggaggggagaaggaccccccagccacacagcccaaggctgcagaagcacctaggtggttagagagtgagtgcctggatggggcgcagtggctcacacctgtaatcccagcactttgggaggccgaggcaggcggatcacgaggtcaagagatcaagaccatcctggccaacatggtgacaccgtgtctctactaaaaatacaaaaataagctgggcatggtggtgcgtgcctgtagtcccatctactcgggaggctgaagcaggagaatcacttgaacctgggaggcaaaggttgcagtgagctgagatcgcgccactgcactccagcctggcaacagagcgagacaagactccatcttcaaaaaaaaaagtgagtgcccgatgatgccagattcttcatcacctgaagtgaacccacacaacagggctgggccatgggcatcataaaccccattttgcaagctcaggaggagctttagggaaatcagaagactggcccagtctctaccaagtggtggatttagagccggcatggcttcgttccaaatctcacccttgtcccaccattccatgggacctcccattcctgagggagcctggatacgggcaagtgcacaacccgggaggttgaggttacagtgagccatgatcgcaccactgcagtccagcccgagcaatagggtgagaccctccctctgaaaaaaataaaaatactcattttggaaggaagtcattctaaaatgttacacttgtcttcagcatatctgcaatataataattttctgcataactgaggatcattcacagaaaccaatggcttttctccagcagtgtcttctgaagttgtaacagtaggggcacggggagctatttgcttttatgctaaatgaccttagaccacttataaaatgcatatgagtgctttaaatgttattttgtgtgtgtgtggtgttgcctccctgactacaaggggtcacttgctactctaaatgtgtttctaatctactagtacaggaacacacatggacacgttaaaattgtgaataaaagtaagtaaaaagta

SEQ ID NO: 354733 - DNA, 3285 bp, Homo sapiens
acccgccccggctactccaacccctgggcgggcgggggtaccgcctgggcaagggccggggcgccgggccgagccacctcttcccctcccccgcttccctgtcgcgctccgctggctggacgcgctggaggagtggagcagcacccggccggccctgggggctgacagtcggcaaagtttggcccgaagaggaagtggtctcaaaccccggcaggtggcgaccaggccagaccaggggcgctcgctgcctgcgggcgggctgtaggcgagggcgcgccccagtgccgagacccggggcttcaggagccggccccgggagagaagagtgcggcggcggacggagaaaacaactccaaagttggcgaaaggcaccgcccctactcccgggctgccgccgcctccccgcccccagccctggcatccagagtacgggtcgagcccgggccatggagcccccctggggaggcggcaccagggagcctgggcgcccggggctccgccgcgaccccatcgggtagaccacagaagctccgggacccttccggcacctctggacagcccaggatgctgttggccaccctcctcctcctcctccttggaggcgctctggcccatccagaccggattatttttccaaatcatgcttgtgaggaccccccagcagtgctcttagaagtgcagggcaccttacagaggcccctggtccgggacagccgcacctcccctgccaactgcacctggctcatcctgggcagcaaggaacagactgtcaccatcaggttccagaagctacacctggcctgtggctcagagcgcttaaccctacgctcccctctccagccactgatctccctgtgtgaggcacctcccagccctctgcagctgcccgggggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctggtacgccgtctccgccgctggggcttgctccctcgaaccaacaccccggctcgggcctctgaggccagatcccaggtcacaccttctgctgctccccttgaggccctagatggtggcacaggtccagcccgtgagggcggggcagtgggtgggcaagatggggagcaggcacccccactgcccatcaaggctcccctcccatctgctagcacgtctccagcccccactactgtccctgaagccccagggccactgccctcactgcccctagagccatcactattgtctggagtggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtgggcctcccgttgaccctatgtagctgctataaagttaagtgtccctcaggcagggagagggctcacagagtctcctctgtacgtggccatggccagacaccccagtcccttcaccaccacctgctcccgtaccagctggtacgggagtggccttggtgccccttggcgggggcgggaggactaaaggggccatgctgtggccacagcgggtccaaatggaagtatctgcagtgtacatacaggagggttggagagaggcatccttttccctaggctgtgcctggggacaagagagaggggaagtacagctggcactgccgtgccaggggcagggtccaggccagccgtgccacctgagcgggcacagcgagctggagctcggctactccttggcgcggcaatgatggtgaggatgtacaggaagatgttgatgatgtctgtgtacaggttc

SEQ ID NO: 354734 - DNA, 3045 bp, Homo sapiens
acccgccccggctactccaacccctgggcgggcgggggtaccgcctgggcaagggccggggcgccgggccgagccacctcttcccctcccccgcttccctgtcgcgctccgctggctggacgcgctggaggagtggagcagcacccggccggccctgggggctgacagtcggcaaagtttggcccgaagaggaagtggtctcaaaccccggcaggtggcgaccaggccagaccaggggcgctcgctgcctgcgggcgggctgtaggcgagggcgcgccccagtgccgagacccggggcttcaggagccggccccgggagagaagagtgcggcggcggacggagaaaacaactccaaagttggcgaaaggcaccgcccctactcccgggctgccgccgcctccccgcccccagccctggcatccagagtacgggtcgagcccgggccatggagcccccctggggaggcggcaccagggagcctgggcgcccggggctccgccgcgaccccatcgggtagaccacagaagctccgggacccttccggcacctctggacagcccaggatgctgttggccaccctcctcctcctcctccttggaggcgctctggcccatccagaccggattatttttccaaatcatgcttgtgaggaccccccagcagtgctcttagaagtgcagggcaccttacagaggcccctggtccgggacagccgcacctcccctgccaactgcacctggctcatcctgggcagcaaggaacagactgtcaccatcaggttccagaagctacacctggcctgtggctcagagcgcttaaccctacgctcccctctccagccactgatctccctgtgtgaggcacctcccagccctctgcagctgcccgggggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctggtacgccgtctccgccgctggggcttgctccctcgaaccaacaccccggctcgggcctctgaggccagatcccaggtcacaccttctgctgctccccttgaggccctagatggtggcacaggtccagcccgtgagggcggggcagtgggtgggcaagatggggagcaggcacccccactgcccatcaaggctcccctcccatctgctagcacgtctccagcccccactactgtccctgaagccccagggccactgccctcactgcccctagagccatcactattgtctggagtggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtgggcctcccgttgaccctatgtagctgctataaagttaagtgtccctcaggcagggagagggctcacagagtctcctctgtacgtccggccacggacacgtaaggaagcattgtaaaataattctgagttttgtgtttgttgtagattgattgtattgttgaaaaagtttgtttttgcgtgggagtgtgtgcctgcgtgggtgtgtacgtgt

SEQ ID NO: 354735 - DNA, 2161 bp, Homo sapiens
acccgccccggctactccaacccctgggcgggcgggggtaccgcctgggcaagggccggggcgccgggccgagccacctcttcccctcccccgcttccctgtcgcgctccgctggctggacgcgctggaggagtggagcagcacccggccggccctgggggctgacagtcggcaaagtttggcccgaagaggaagtggtctcaaaccccggcaggtggcgaccaggccagaccaggggcgctcgctgcctgcgggcgggctgtaggcgagggcgcgccccagtgccgagacccggggcttcaggagccggccccgggagagaagagtgcggcggcggacggagaaaacaactccaaagttggcgaaaggcaccgcccctactcccgggctgccgccgcctccccgcccccagccctggcatccagagtacgggtcgagcccgggccatggagcccccctggggaggcggcaccagggagcctgggcgcccggggctccgccgcgaccccatcgggtagaccacagaagctccgggacccttccggcacctctggacagcccaggatgctgttggccaccctcctcctcctcctccttggaggcgctctggcccatccagaccggattatttttccaaatcatgcttgtgaggaccccccagcagtgctcttagaagtgcagggcaccttacagaggcccctggtccgggacagccgcacctcccctgccaactgcacctggctcatcctgggcagcaaggaacagactgtcaccatcaggttccagaagctacacctggcctgtggctcagagcgcttaaccctacgctcccctctccagccactgatctccctgtgtgaggcacctcccagccctctgcagctgcccgggggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgatgacggcgggcacctgggccacctcctggagtcatatccgtcga

SEQ ID NO: 354736 - DNA, 1723 bp, Homo sapiens
acccgccccggctactccaacccctgggcgggcgggggtaccgcctgggcaagggccggggcgccgggccgagccacctcttcccctcccccgcttccctgtcgcgctccgctggctggacgcgctggaggagtggagcagcacccggccggccctgggggctgacagtcggcaaagtttggcccgaagaggaagtggtctcaaaccccggcaggtggcgaccaggccagaccaggggcgctcgctgcctgcgggcgggctgtaggcgagggcgcgccccagtgccgagacccggggcttcaggagccggccccgggagagaagagtgcggcggcggacggagaaaacaactccaaagttggcgaaaggcaccgcccctactcccgggctgccgccgcctccccgcccccagccctggcatccagagtacgggtcgagcccgggccatggagcccccctggggaggcggcaccagggagcctgggcgcccggggctccgccgcgaccccatcgggtagaccacagaagctccgggacccttccggcacctctggacagcccaggatgctgttggccaccctcctcctcctcctccttggaggcgctctggcccatccagaccggattatttttccaaatcatgcttgtgaggaccccccagcagtgctcttagaagtgcagggcaccttacagaggcccctggtccgggacagccgcacctcccctgccaactgcacctggctcatcctgggcagcaaggaacagactgtcaccatcaggttccagaagctacacctggcctgtggctcagagcgcttaaccctacgctcccctctccagccactgatctccctgtgtgaggcacctcccagccctctgcagctgcccgggggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacgccaccaccatttgggtggctgtttttaaaaagtaaagttcttagaggatcataggtctggacactccatccttgccaaacctctacccaaaagtggccttaagcaccggaatgccaattaactagagaccctccagcccccaaggggaggatttgggcagaacctgaggttttgccatccacaatccctcctacagggcctggctcacaaaaagagtgcaacaaatgcttctattccatagctacggcattgctcagtaagttgaggtcaaaaataaaggaatcatacatctca

SEQ ID NO: 354737 - DNA, 2424 bp, Homo sapiens
cagagtctgatcttatttatttgttactcaatcttatttctgactggattcagacttagaagtagaagctcgcagagaggaaagtctgcgtctcttcgcaatttgttcctggcgcttctccttagcctccttcattctcttggccttcagtgattttccctcccctgcctctccatagcctggtcttttgccctctcctttgctcttctcttcccccatagccacctcaaatacctgcagcctgatatcttcatcccttcatccagaccttttctctcctagtggtattgcaaactgaaagtggacaaagacttaaggtaaacctgctcctcatggtggaatgcttccaaatgctggaaggaggactttagggcagagttcactaaggaggcttgtgcttatagatcagtgggcctgaaagaagtttctctaggttctggttgtgtgctgtacgaggtgtaggtagtaataatactcttgtcagccacagtgaagccccaagctagccgggataggggactgaccttgtacaggcagcatggagaaactaagacagagtgtcctgcccaagtgatggcactggggagcagtcactcaggtttatttccaccagggcccaagaaaaaaagaaatgaggcaacctaaaattccatcaagatagataccaatatccaaggtgcttggtcttagcggtgtgggacccacgttaaggctcttggtgggaaggtgggaggtgttttcagcatgagatagggttcaggctgtgaatcagagtctagagcctaagataaaagaagataccagggctgggccacggtggctttcgcctgtaatcctagcactttgggaggccaaggcaggcagactgcctgagctcaggagttcgagactagcctgagcaacacggtgaaaccctgtctctactaaaatacaaaaaagtagccaggtgtggcggcatgcacctgtagtcccagctactcgagaggctgaggcaggagaattgcttgaacccgggaggcggaggttgcagtgagtggagatcgcgccactgcactctagcctgggtgacagagcgagactccttctccaaaaaaaaagaaaagaagataccagaactcagtccttaagaaacaaaattctgccaggcgcagtagctcacacctgtaatcccagcactttggaggggccaaggcaggcggatcgcttgaggccaagagttcaagaacagcctgggcaacatgatgaaaccctgtctctaccaaaaatactaaaaattagccagtctcacaacctggtctcaaaataaataaatagatttaaaaaaaaaatcatgggcctgaaccaagctccagacctcactaggaggggagaaggaccccccagccacacagcccaaggctgcagaagcacctaggtggttagagagtgagtgcctggatggggcgcagtggctcacacctgtaatcccagcactttgggaggccgaggcaggcggatcacgaggtcaagagatcaagaccatcctggccaacatggtgacaccgtgtctctactaaaaatacaaaaataagctgggcatggtggtgcgtgcctgtagtcccatctactcgggaggctgaagcaggagaatcacttgaacctgggaggcaaaggttgcagtgagctgagatcgcgccactgcactccagcctggcaacagagcgagacaagactccatcttcaaaaaaaaaagtgagtgcccgatgatgccagattcttcatcacctgaagtgaacccacacaacagggctgggccatgggcatcataaaccccattttgcaagctcaggaggagctttagggaaatcagaagactggcccagtctctaccaagtggtggatttagagccggcatggcttcgttccaaatctcacccttgtcccaccattccatgggacctcccattcctgagggagcctggatacgggcaagtgcacaacccgggaggttgaggttacagtgagccatgatcgcaccactgcagtccagcccgagcaatagggtgagaccctccctctgaaaaaaataaaaatactcattttggaaggaagtcattctaaaatgttacacttgtcttcagcatatctgcaatataataattttctgcataactgaggatcattcacagaaaccaatggcttttctccagcagtgtcttctgaagttgtaacagtaggggcacggggagctatttgcttttatgctaaatgaccttagaccacttataaaatgcatatgagtgctttaaatgttattttgtgtgtgtgtggtgttgcctccctgactacaaggggtcacttgctactctaaatgtgtttctaatctactagtacaggaacacacatggacacgttaaaattgtgaataaaagtaagtaaaaagta

SEQ ID NO: 354738 - DNA, 3260 bp, Homo sapiens
acccgccccggctactccaacccctgggcgggcgggggtaccgcctgggcaagggccggggcgccgggccgagccacctcttcccctcccccgcttccctgtcgcgctccgctggctggacgcgctggaggagtggagcagcacccggccggccctgggggctgacagtcggcaaagtttggcccgaagaggaagtggtctcaaaccccggcaggtggcgaccaggccagaccaggggcgctcgctgcctgcgggcgggctgtaggcgagggcgcgccccagtgccgagacccggggcttcaggagccggccccgggagagaagagtgcggcggcggacggagaaaacaactccaaagttggcgaaaggcaccgcccctactcccgggctgccgccgcctccccgcccccagccctggcatccagagtacgggtcgagcccgggccatggagcccccctggggaggcggcaccagggagcctgggcgcccggggctccgccgcgaccccatcgggtagaccacagaagctccgggacccttccggcacctctggacagcccaggatgctgttggccaccctcctcctcctcctccttggaggcgctctggcccatccagaccggattatttttccaaatcatgcttgtgaggaccccccagcagtgctcttagaagtgcagggcaccttacagaggcccctggtccgggacagccgcacctcccctgccaactgcacctggctcatcctgggcagcaaggaacagactgtcaccatcaggttccagaagctacacctggcctgtggctcagagcgcttaaccctacgctcccctctccagccactgatctccctgtgtgaggcacctcccagccctctgcagctgcccgggggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctggtacgccgtctccgccgctggggcttgctccctcgaaccaacaccccggctcgggcctctgaggccagatcccaggtcacaccttctgctgctccccttgaggccctagatggtggcacaggtccagcccgtgagggcggggcagtgggtgggcaagatggggagcaggcacccccactgcccatcaaggctcccctcccatctgctagcacgtctccagcccccactactgtccctgaagccccagggccactgccctcactgcccctagagccatcactattgtctggagtggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtgggcctcccgttgaccctatgtagctgctataaagttaagtgtccctcaggcagggagagggctcacagagtctcctctgtacgtggccatggccagacaccccagtcccttcaccaccacctgctccccacgccaccaccatttgggtggctgtttttaaaaagtaaagttcttagaggatcataggtctggacactccatccttgccaaacctctacccaaaagtggccttaagcaccggaatgccaattaactagagaccctccagcccccaaggggaggatttgggcagaacctgaggttttgccatccacaatccctcctacagggcctggctcacaaaaagagtgcaacaaatgcttctattccatagctacggcattgctcagtaagttgaggtcaaaaataaaggaatcatacatctca

SEQ ID NO: 354739 - DNA, 2843 bp, Homo sapiens
cagaattgttcgtgatattagtatttactggtgaagctatgaagaatgtggagagaaagagcgaagctagaaggctgtaactctaggctgtgtgtgggcaggggcagatactctgctcctccttgcagagcccagacttttggaaacctcaagcctccaagcggaaggggaagggtgggatgcaaaggggctgtctactacccgtgtcctaccttcctctctccagcttgtgaggaccccccagcagtgctcttagaagtgcagggcaccttacagaggcccctggtccgggacagccgcacctcccctgccaactgcacctggctcatcctgggcagcaaggaacagactgtcaccatcaggttccagaagctacacctggcctgtggctcagagcgcttaaccctacgctcccctctccagccactgatctccctgtgtgaggcacctcccagccctctgcagctgcccgggggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctggtacgccgtctccgccgctggggcttgctccctcgaaccaacaccccggctcgggcctctgaggccagatcccaggtcacaccttctgctgctccccttgaggccctagatggtggcacaggtccagcccgtgagggcggggcagtgggtgggcaagatggggagcaggcacccccactgcccatcaaggctcccctcccatctgctagcacgtctccagcccccactactgtccctgaagccccagggccactgccctcactgcccctagagccatcactattgtctggagtggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtgggcctcccgttgaccctatgtagctgctataaagttaagtgtccctcaggcagggagagggctcacagagtctcctctgtacgtggccatggccagacaccccagtcccttcaccaccacctgctccccacgccaccaccatttgggtggctgtttttaaaaagtaaagttcttagaggatcataggtctggacactccatccttgccaaacctctacccaaaagtggccttaagcaccggaatgccaattaactagagaccctccagcccccaaggggaggatttgggcagaacctgaggttttgccatccacaatccctcctacagggcctggctcacaaaaagagtgcaacaaatgcttctattccatagctacggcattgctcagtaagttgaggtcaaaaataaaggaatcatacatctca

SEQ ID NO: 354740 - DNA, 6790 bp, Homo sapiens
acccgccccggctactccaacccctgggcgggcgggggtaccgcctgggcaagggccggggcgccgggccgagccacctcttcccctcccccgcttccctgtcgcgctccgctggctggacgcgctggaggagtggagcagcacccggccggccctgggggctgacagtcggcaaagtttggcccgaagaggaagtggtctcaaaccccggcaggtggcgaccaggccagaccaggggcgctcgctgcctgcgggcgggctgtaggcgagggcgcgccccagtgccgagacccggggcttcaggagccggccccgggagagaagagtgcggcggcggacggagaaaacaactccaaagttggcgaaaggcaccgcccctactcccgggctgccgccgcctccccgcccccagccctggcatccagagtacgggtcgagcccgggccatggagcccccctggggaggcggcaccagggagcctgggcgcccggggctccgccgcgaccccatcgggtagaccacagaagctccgggacccttccggcacctctggacagcccaggatgctgttggccaccctcctcctcctcctccttggaggcgctctggcccatccagaccggattatttttccaaatcatgcttgtgaggaccccccagcagtgctcttagaagtgcagggcaccttacagaggcccctggtccgggacagccgcacctcccctgccaactgcacctggctcatcctgggcagcaaggaacagactgtcaccatcaggttccagaagctacacctggcctgtggctcagagcgcttaaccctacgctcccctctccagccactgatctccctgtgtgaggcacctcccagccctctgcagctgcccgggggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctggtacgccgtctccgccgctggggcttgctccctcgaaccaacaccccggctcgggcctctgaggccagatcccaggtcacaccttctgctgctccccttgaggccctagatggtggcacaggtccagcccgtgagggcggggcagtgggtgggcaagatggggagcaggcacccccactgcccatcaaggctcccctcccatctgctagcacgtctccagcccccactactgtccctgaagccccagggccactgccctcactgcccctagagccatcactattgtctggagtggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtgggcctcccgttgaccctatgtagctgctataaagttaagtgtccctcaggcagggagagggctcacagagtctcctctgtacgtggccatggccagacaccccagtcccttcaccaccacctgctccccacgccaccaccatttgggtggctgtttttaaaaagtaaagttcttagaggatcataggtctggacactccatccttgccaaacctctacccaaaagtggccttaagcaccggaatgccaattaactagagaccctccagcccccaaggggaggatttgggcagaacctgaggttttgccatccacaatccctcctacagggcctggctcacaaaaagagtgcaacaaatgcttctattccatagctacggcattgctcagtaagttgaggtcaaaaataaaggaatcatacatctcaaaattttgcaaattagctgcgagcctgagccccgcctctgcccatctcagtctatgctcacctcatcccactcctccctgtggagccctttgcttggccctctacctcctgccctcttcctgttcatctcccaaccactgcactcttgatttttataccacacagaaggtaagaaaattctaggaaccctaaggatcaatcctctccattttcactcaaatgcctggggcccagctctgcaatgactgactccagggcctctttcctcactgccagcatagaagtcaggggagccagctgggccctgcggtcaggaaggttctcatttttggagcattccctgagcccagatcataggagcagctgtccctggtgggacacaggagtcatgactcctaccctccaccctccacacccaccaggcatttagcagtctgtcctatgcaagacagatgaattctcagccaggatacctcaaggcaggcaaaggtgagtggagggaaaattcacaaacattcagggtgtgtggtgctggcatcaccatggccaaatccaagaggtcttcctggaagagggcccaaactggaaccaaaagaatgctgtcagcagttggaatagagctgtgaattctagacagggggagtgtccccagaacaagcaaacggaggagacaagagggcaagggttataggaaagaccctgggcctgagagcacaagcagcggccagagctgcagcgctggggtgggtgatggagggaatgattcgcaagcagtgttggaacccagcccctagtgagcaaagtgacagaagctgccccagagtttggaaggaagatcgaggcagaagatgtagaaggaagctgtgggggtgggagtgatgcctcaggaacaaaactgaggaattccctaacggacccagtccctggggaaagaggctcccctcaggctctccttgtctagccccacacctggcagagcctgtcacccagcctagccccacgcctggcagagcccatcacccagcctagccccacacctggtggagaggccctgttgattacaccctgtcagcctcctcaaacccagcactaattgcacaattttcctctcttctagtgagcaagagcctgaggaagtagcagagaggggtgtgggcccatgtgcagttctgggaccctggcaccttggctcagggaagacccgagctcctttcactgcagaccctctccagagactggggagagggctctggagaacctggttcttgcttactgttctccctttgggccctccttcccaaacgcaaacaatccaggatccactcagcgtcaggcccaatggaaatagtgaagcagtgattttccctcccctgcctctccatagcctggtcttttgccctctcctttgctcttctcttcccccatagccacctcaaatacctgcagcctgatatcttcatcccttcatccagaccttttctctcctagtggtattgcaaactgaaagtggacaaagacttaaggtaaacctgctcctcatggtggaatgcttccaaatgctggaaggaggactttagggcagagttcactaaggaggcttgtgcttatagatcagtgggcctgaaagaagtttctctaggttctggttgtgtgctgtacgaggtgtaggtagtaataatactcttgtcagccacagtgaagccccaagctagccgggataggggactgaccttgtacaggcagcatggagaaactaagacagagtgtcctgcccaagtgatggcactggggagcagtcactcaggtttatttccaccagggcccaagaaaaaaagaaatgaggcaacctaaaattccatcaagatagataccaatatccaaggtgcttggtcttagcggtgtgggacccacgttaaggctcttggtgggaaggtgggaggtgttttcagcatgagatagggttcaggctgtgaatcagagtctagagcctaagataaaagaagataccagggctgggccacggtggctttcgcctgtaatcctagcactttgggaggccaaggcaggcagactgcctgagctcaggagttcgagactagcctgagcaacacggtgaaaccctgtctctactaaaatacaaaaaagtagccaggtgtggcggcatgcacctgtagtcccagctactcgagaggctgaggcaggagaattgcttgaacccgggaggcggaggttgcagtgagtggagatcgcgccactgcactctagcctgggtgacagagcgagactccttctccaaaaaaaaagaaaagaagataccagaactcagtccttaagaaacaaaattctgccaggcgcagtagctcacacctgtaatcccagcactttggaggggccaaggcaggcggatcgcttgaggccaagagttcaagaacagcctgggcaacatgatgaaaccctgtctctaccaaaaatactaaaaattagccagtctcacaacctggtctcaaaataaataaatagatttaaaaaaaaaatcatgggcctgaaccaagctccagacctcactaggaggggagaaggaccccccagccacacagcccaaggctgcagaagcacctaggtggttagagagtgagtgcctggatggggcgcagtggctcacacctgtaatcccagcactttgggaggccgaggcaggcggatcacgaggtcaagagatcaagaccatcctggccaacatggtgacaccgtgtctctactaaaaatacaaaaataagctgggcatggtggtgcgtgcctgtagtcccatctactcgggaggctgaagcaggagaatcacttgaacctgggaggcaaaggttgcagtgagctgagatcgcgccactgcactccagcctggcaacagagcgagacaagactccatcttcaaaaaaaaaagtgagtgcccgatgatgccagattcttcatcacctgaagtgaacccacacaacagggctgggccatgggcatcataaaccccattttgcaagctcaggaggagctttagggaaatcagaagactggcccagtctctaccaagtggtggatttagagccggcatggcttcgttccaaatctcacccttgtcccaccattccatgggacctcccattcctgagggagcctggatacgggcaagtgcacaacccgggaggttgaggttacagtgagccatgatcgcaccactgcagtccagcccgagcaatagggtgagaccctccctctgaaaaaaataaaaatactcattttggaaggaagtcattctaaaatgttacacttgtcttcagcatatctgcaatataataattttctgcataactgaggatcattcacagaaaccaatggcttttctccagcagtgtcttctgaagttgtaacactaccgccgcccgaacgctctccgcccccagcggacagcgcgcgccaccagacgttgggtgggggtggagggggagcgcctggcgcccgccgggctccccgggggcggccgc

SEQ ID NO: 354741 - DNA, 5983 bp, Homo sapiens
acccgccccggctactccaacccctgggcgggcgggggtaccgcctgggcaagggccggggcgccgggccgagccacctcttcccctcccccgcttccctgtcgcgctccgctggctggacgcgctggaggagtggagcagcacccggccggccctgggggctgacagtcggcaaagtttggcccgaagaggaagtggtctcaaaccccggcaggtggcgaccaggccagaccaggggcgctcgctgcctgcgggcgggctgtaggcgagggcgcgccccagtgccgagacccggggcttcaggagccggccccgggagagaagagtgcggcggcggacggagaaaacaactccaaagttggcgaaaggcaccgcccctactcccgggctgccgccgcctccccgcccccagccctggcatccagagtacgggtcgagcccgggccatggagcccccctggggaggcggcaccagggagcctgggcgcccggggctccgccgcgaccccatcgggtagaccacagaagctccgggacccttccggcacctctggacagcccaggatgctgttggccaccctcctcctcctcctccttggaggcgctctggcccatccagaccggattatttttccaaatcatgcttgtgaggaccccccagcagtgctcttagaagtgcagggcaccttacagaggcccctggtccgggacagccgcacctcccctgccaactgcacctggctcatcctgggcagcaaggaacagactgtcaccatcaggttccagaagctacacctggcctgtggctcagagcgcttaaccctacgctcccctctccagccactgatctccctgtgtgaggcacctcccagccctctgcagctgcccgggggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctggtacgccgtctccgccgctggggcttgctccctcgaaccaacaccccggctcgggcctctgaggccagatcccaggtcacaccttctgctgctccccttgaggccctagatggtggcacaggtccagcccgtgagggcggggcagtgggtgggcaagatggggagcaggcacccccactgcccatcaaggctcccctcccatctgctagcacgtctccagcccccactactgtccctgaagccccagggccactgccctcactgcccctagagccatcactattgtctggagtggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtgggcctcccgttgaccctatgtagctgctataaagttaagtgtccctcaggcagggagagggctcacagagtctcctctgtacgtggccatggccagacaccccagtcccttcaccaccacctgctccccacgccaccaccatttgggtggctgtttttaaaaagtaaagttcttagaggatcataggtctggacactccatccttgccaaacctctacccaaaagtggccttaagcaccggaatgccaattaactagagaccctccagcccccaaggggaggatttgggcagaacctgaggttttgccatccacaatccctcctacagggcctggctcacaaaaagagtgcaacaaatgcttctattccatagctacggcattgctcagtaagttgaggtcaaaaataaaggaatcatacatctcaaaattttgcaaattagctgcgagcctgagccccgcctctgcccatctcagtctatgctcacctcatcccactcctccctgtggagccctttgcttggccctctacctcctgccctcttcctgttcatctcccaaccactgcactcttgatttttataccacacagaaggtaagaaaattctaggaaccctaaggatcaatcctctccattttcactcaaatgcctggggcccagctctgcaatgactgactccagggcctctttcctcactgccagcatagaagtcaggggagccagctgggccctgcggtcaggaaggttctcatttttggagcattccctgagcccagatcataggagcagctgtccctggtgggacacaggagtcatgactcctaccctccaccctccacacccaccaggcatttagcagtctgtcctatgcaagacagatgaattctcagccaggatacctcaaggcaggcaaaggtgagtggagggaaaattcacaaacattcagggtgtgtggtgctggcatcaccatggccaaatccaagaggtcttcctggaagagggcccaaactggaaccaaaagaatgctgtcagcagttggaatagagctgtgaattctagacagggggagtgtccccagaacaagcaaacggaggagacaagagggcaagggttataggaaagaccctgggcctgagagcacaagcagcggccagagctgcagcgctggggtgggtgatggagggaatgattcgcaagcagtgttggaacccagcccctagtgagcaaagtgacagaagctgccccagagtttggaaggaagatcgaggcagaagatgtagaaggaagctgtgggggtgggagtgatgcctcaggaacaaaactgaggaattccctaacggacccagtccctggggaaagaggctcccctcaggctctccttgtctagccccacacctggcagagcctgtcacccagcctagccccacgcctggcagagcccatcacccagcctagccccacacctggtggagaggccctgttgattacaccctgtcagcctcctcaaacccagcactaattgcacaattttcctctcttctagtgagcaagagcctgaggaagtagcagagaggggtgtgggcccatgtgcagttctgggaccctggcaccttggctcagggaagacccgagctcctttcactgcagaccctctccagagactggggagagggctctggagaacctggttcttgcttactgttctccctttgggccctccttcccaaacgcaaacaatccaggatccactcagcgtcaggcccaatggaaatagtgaagcagtgattttccctcccctgcctctccatagcctggtcttttgccctctcctttgctcttctcttcccccatagccacctcaaatacctgcagcctgatatcttcatcccttcatccagaccttttctctcctagtggtattgcaaactgaaagtggacaaagacttaaggtaaacctgctcctcatggtggaatgcttccaaatgctggaaggaggactttagggcagagttcactaaggaggcttgtgcttatagatcagtgggcctgaaagaagtttctctaggttctggttgtgtgctgtacgaggtgtaggtagtaataatactcttgtcagccacagtgaagccccaagctagccgggataggggactgaccttgtacaggcagcatggagaaactaagacagagtgtcctgcccaagtgatggcactggggagcagtcactcaggtttatttccaccagggcccaagaaaaaaagaaatgaggcaacctaaaattccatcaagatagataccaatatccaaggtgcttggtcttagcggtgtgggacccacgttaaggctcttggtgggaaggtgggaggtgttttcagcatgagatagggttcaggctgtgaatcagagtctagagcctaagataaaagaagataccagggctgggccacggtggctttcgcctgtaatcctagcactttgggaggccaaggcaggcagactgcctgagctcaggagttcgagactagcctgagcaacacggtgaaaccctgtctctactaaaatacaaaaaagtagccaggtgtggcggcatgcacctgtagtcccagctactcgagaggctgaggcaggagaattgcttgaacccgggaggcggaggttgcagtgagtggagatcgcgccactgcactctagcctgggtgacagagcgagactccttctccaaaaaaaaagaaaagaagataccagaactcagtccttaagaaacaaaattctgccaggcgcagtagctcacacctgtaatcccagcactttggaggggccaaggcaggcggatcgcttgaggccaagagttcaagaacagcctgggcaacatgatgaaaccctgtctctaccaaaaatactaaaaattagccagtctcacaacctggtctcaaaataaataaatagatttaaaaaaaaaatcatgggcctgaaccaagctccagacctcactaggaggggagaaggaccccccagccacacagcccaaggctgcagaagcacctaggtggttagagagtgagtgcctggatggggcgcagtggctcacacctgtaatcccagcactttgggaggccgaggcaggcggatcacgaggtcaagagatcaagaccatcctggccaacatggtgacaccgtgtctctactaaaaatacaaaaataagctgggcatggtggtgcgtgcctgtagtcccatctactcgggaggctgaagcaggagaatcacttgaacctgggaggcaaaggttgcagtgagctgagatcgcgccactgcactccagcctggcaacagagcgagacaagactccatcttcaaaaaaaaaagtgagtgcccgatgatgccagattcttcatcacctgaagtgaacccacacaacagggctgggccatgggcatcataaaccccattttgcaagctcaggaggagctttagggaaatcagaagactggcccagtctctaccaagtggtggatttagagccggcatggcttcgttccaaatctcacccttgtcccaccattccatgggacctcccattcctgagggagcctggatacgggcaagtgcacaacccgggaggttgaggttacagtgagccatgatcgcaccactgcagtccagcccgagcaatagggtgagaccctccctctgaaaaaaataaaaatactcattttggaaggaagtcattctaaaatgttacacttgtcttcagcatatctgcaatataataattttctgcataactgaggatcattcacagaaaccaatggcttttctccagcagtgtcttctgaagttgtaacagtaggggcacggggagctatttgcttttatgctaaatgaccttagaccacttataaaatgcatatgagtgctttaaatgttattttgtgtgtgtgtggtgttgcctccctgactacaaggggtcacttgctactctaaatgtgtttctaatctactagtacaggaacacacatggacacgttaaaattgtgaataaaagtaagtaaaaagta

SEQ ID NO: 354742 - DNA, 6130 bp, Homo sapiens
acccgccccggctactccaacccctgggcgggcgggggtaccgcctgggcaagggccggggcgccgggccgagccacctcttcccctcccccgcttccctgtcgcgctccgctggctggacgcgctggaggagtggagcagcacccggccggccctgggggctgacagtcggcaaagtttggcccgaagaggaagtggtctcaaaccccggcaggtggcgaccaggccagaccaggggcgctcgctgcctgcgggcgggctgtaggcgagggcgcgccccagtgccgagacccggggcttcaggagccggccccgggagagaagagtgcggcggcggacggagaaaacaactccaaagttggcgaaaggcaccgcccctactcccgggctgccgccgcctccccgcccccagccctggcatccagagtacgggtcgagcccgggccatggagcccccctggggaggcggcaccagggagcctgggcgcccggggctccgccgcgaccccatcgggtagaccacagaagctccgggacccttccggcacctctggacagcccaggatgctgttggccaccctcctcctcctcctccttggaggcgctctggcccatccagaccggattatttttccaaatcatgcttgtgaggaccccccagcagtgctcttagaagtgcagggcaccttacagaggcccctggtccgggacagccgcacctcccctgccaactgcacctggctcatcctgggcagcaaggaacagactgtcaccatcaggttccagaagctacacctggcctgtggctcagagcgcttaaccctacgctcccctctccagccactgatctccctgtgtgaggcacctcccagccctctgcagctgcccgggggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctgcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagagggcctggctcacaaaaagagtgcaacaaatgcttctattccatagctacggcattgctcagtaagttgaggtcaaaaataaaggaatcatacatctcaaaattttgcaaattagctgcgagcctgagccccgcctctgcccatctcagtctatgctcacctcatcccactcctccctgtggagccctttgcttggccctctacctcctgccctcttcctgttcatctcccaaccactgcactcttgatttttataccacacagaaggtaagaaaattctaggaaccctaaggatcaatcctctccattttcactcaaatgcctggggcccagctctgcaatgactgactccagggcctctttcctcactgccagcatagaagtcaggggagccagctgggccctgcggtcaggaaggttctcatttttggagcattccctgagcccagatcataggagcagctgtccctggtgggacacaggagtcatgactcctaccctccaccctccacacccaccaggcatttagcagtctgtcctatgcaagacagatgaattctcagccaggatacctcaaggcaggcaaaggtgagtggagggaaaattcacaaacattcagggtgtgtggtgctggcatcaccatggccaaatccaagaggtcttcctggaagagggcccaaactggaaccaaaagaatgctgtcagcagttggaatagagctgtgaattctagacagggggagtgtccccagaacaagcaaacggaggagacaagagggcaagggttataggaaagaccctgggcctgagagcacaagcagcggccagagctgcagcgctggggtgggtgatggagggaatgattcgcaagcagtgttggaacccagcccctagtgagcaaagtgacagaagctgccccagagtttggaaggaagatcgaggcagaagatgtagaaggaagctgtgggggtgggagtgatgcctcaggaacaaaactgaggaattccctaacggacccagtccctggggaaagaggctcccctcaggctctccttgtctagccccacacctggcagagcctgtcacccagcctagccccacgcctggcagagcccatcacccagcctagccccacacctggtggagaggccctgttgattacaccctgtcagcctcctcaaacccagcactaattgcacaattttcctctcttctagtgagcaagagcctgaggaagtagcagagaggggtgtgggcccatgtgcagttctgggaccctggcaccttggctcagggaagacccgagctcctttcactgcagaccctctccagagactggggagagggctctggagaacctggttcttgcttactgttctccctttgggccctccttcccaaacgcaaacaatccaggatccactcagcgtcaggcccaatggaaatagtgaagcagtgattttccctcccctgcctctccatagcctggtcttttgccctctcctttgctcttctcttcccccatagccacctcaaatacctgcagcctgatatcttcatcccttcatccagaccttttctctcctagtggtattgcaaactgaaagtggacaaagacttaaggtaaacctgctcctcatggtggaatgcttccaaatgctggaaggaggactttagggcagagttcactaaggaggcttgtgcttatagatcagtgggcctgaaagaagtttctctaggttctggttgtgtgctgtacgaggtgtaggtagtaataatactcttgtcagccacagtgaagccccaagctagccgggataggggactgaccttgtacaggcagcatggagaaactaagacagagtgtcctgcccaagtgatggcactggggagcagtcactcaggtttatttccaccagggcccaagaaaaaaagaaatgaggcaacctaaaattccatcaagatagataccaatatccaaggtgcttggtcttagcggtgtgggacccacgttaaggctcttggtgggaaggtgggaggtgttttcagcatgagatagggttcaggctgtgaatcagagtctagagcctaagataaaagaagataccagggctgggccacggtggctttcgcctgtaatcctagcactttgggaggccaaggcaggcagactgcctgagctcaggagttcgagactagcctgagcaacacggtgaaaccctgtctctactaaaatacaaaaaagtagccaggtgtggcggcatgcacctgtagtcccagctactcgagaggctgaggcaggagaattgcttgaacccgggaggcggaggttgcagtgagtggagatcgcgccactgcactctagcctgggtgacagagcgagactccttctccaaaaaaaaagaaaagaagataccagaactcagtccttaagaaacaaaattctgccaggcgcagtagctcacacctgtaatcccagcactttggaggggccaaggcaggcggatcgcttgaggccaagagttcaagaacagcctgggcaacatgatgaaaccctgtctctaccaaaaatactaaaaattagccagtctcacaacctggtctcaaaataaataaatagatttaaaaaaaaaatcatgggcctgaaccaagctccagacctcactaggaggggagaaggaccccccagccacacagcccaaggctgcagaagcacctaggtggttagagagtgagtgcctggatggggcgcagtggctcacacctgtaatcccagcactttgggaggccgaggcaggcggatcacgaggtcaagagatcaagaccatcctggccaacatggtgacaccgtgtctctactaaaaatacaaaaataagctgggcatggtggtgcgtgcctgtagtcccatctactcgggaggctgaagcaggagaatcacttgaacctgggaggcaaaggttgcagtgagctgagatcgcgccactgcactccagcctggcaacagagcgagacaagactccatcttcaaaaaaaaaagtgagtgcccgatgatgccagattcttcatcacctgaagtgaacccacacaacagggctgggccatgggcatcataaaccccattttgcaagctcaggaggagctttagggaaatcagaagactggcccagtctctaccaagtggtggatttagagccggcatggcttcgttccaaatctcacccttgtcccaccattccatgggacctcccattcctgagggagcctggatacgggcaagtgcacaacccgggaggttgaggttacagtgagccatgatcgcaccactgcagtccagcccgagcaatagggtgagaccctccctctgaaaaaaataaaaatactcattttggaaggaagtcattctaaaatgttacacttgtcttcagcatatctgcaatataataattttctgcataactgaggatcattcacagaaaccaatggcttttctccagcagtgtcttctgaagttgtaacagtaggggcacggggagctatttgcttttatgctaaatgaccttagaccacttataaaatgcatatgagtgctttaaatgttattttgtgtgtgtgtggtgttgcctccctgactacaaggggtcacttgctactctaaatgtgtttctaatctactagtacaggaacacacatggacacgttaaaattgtgaataaaagtaagtaaaaagta

SEQ ID NO: 354743 - DNA, 4745 bp, Homo sapiens
acccgccccggctactccaacccctgggcgggcgggggtaccgcctgggcaagggccggggcgccgggccgagccacctcttcccctcccccgcttccctgtcgcgctccgctggctggacgcgctggaggagtggagcagcacccggccggccctgggggctgacagtcggcaaagtttggcccgaagaggaagtggtctcaaaccccggcaggtggcgaccaggccagaccaggggcgctcgctgcctgcgggcgggctgtaggcgagggcgcgccccagtgccgagacccggggcttcaggagccggccccgggagagaagagtgcggcggcggacggagaaaacaactccaaagttggcgaaaggcaccgcccctactcccgggctgccgccgcctccccgcccccagccctggcatccagagtacgggtcgagcccgggccatggagcccccctggggaggcggcaccagggagcctgggcgcccggggctccgccgcgaccccatcgggtagaccacagaagctccgggacccttccggcacctctggacagcccaggatgctgttggccaccctcctcctcctcctccttggaggcgctctggcccatccagaccggattatttttccaaatcatgcttgtgaggaccccccagcagtgctcttagaagtgcagggcaccttacagaggcccctggtccgggacagccgcacctcccctgccaactgcacctggctcatcctgggcagcaaggaacagactgtcaccatcaggttccagaagctacacctggcctgtggctcagagcgcttaaccctacgctcccctctccagccactgatctccctgtgtgaggcacctcccagccctctgcagctgcccgggggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctgtgagcaagagcctgaggaagtagcagagaggggtgtgggcccatgtgcagttctgggaccctggcaccttggctcagggaagacccgagctcctttcactgcagaccctctccagagactggggagagggctctggagaacctggttcttgcttactgttctccctttgggccctccttcccaaacgcaaacaatccaggatccactcagcgtcaggcccaatggaaatagtgaagcagtgattttccctcccctgcctctccatagcctggtcttttgccctctcctttgctcttctcttcccccatagccacctcaaatacctgcagcctgatatcttcatcccttcatccagaccttttctctcctagtggtattgcaaactgaaagtggacaaagacttaaggtaaacctgctcctcatggtggaatgcttccaaatgctggaaggaggactttagggcagagttcactaaggaggcttgtgcttatagatcagtgggcctgaaagaagtttctctaggttctggttgtgtgctgtacgaggtgtaggtagtaataatactcttgtcagccacagtgaagccccaagctagccgggataggggactgaccttgtacaggcagcatggagaaactaagacagagtgtcctgcccaagtgatggcactggggagcagtcactcaggtttatttccaccagggcccaagaaaaaaagaaatgaggcaacctaaaattccatcaagatagataccaatatccaaggtgcttggtcttagcggtgtgggacccacgttaaggctcttggtgggaaggtgggaggtgttttcagcatgagatagggttcaggctgtgaatcagagtctagagcctaagataaaagaagataccagggctgggccacggtggctttcgcctgtaatcctagcactttgggaggccaaggcaggcagactgcctgagctcaggagttcgagactagcctgagcaacacggtgaaaccctgtctctactaaaatacaaaaaagtagccaggtgtggcggcatgcacctgtagtcccagctactcgagaggctgaggcaggagaattgcttgaacccgggaggcggaggttgcagtgagtggagatcgcgccactgcactctagcctgggtgacagagcgagactccttctccaaaaaaaaagaaaagaagataccagaactcagtccttaagaaacaaaattctgccaggcgcagtagctcacacctgtaatcccagcactttggaggggccaaggcaggcggatcgcttgaggccaagagttcaagaacagcctgggcaacatgatgaaaccctgtctctaccaaaaatactaaaaattagccagtctcacaacctggtctcaaaataaataaatagatttaaaaaaaaaatcatgggcctgaaccaagctccagacctcactaggaggggagaaggaccccccagccacacagcccaaggctgcagaagcacctaggtggttagagagtgagtgcctggatggggcgcagtggctcacacctgtaatcccagcactttgggaggccgaggcaggcggatcacgaggtcaagagatcaagaccatcctggccaacatggtgacaccgtgtctctactaaaaatacaaaaataagctgggcatggtggtgcgtgcctgtagtcccatctactcgggaggctgaagcaggagaatcacttgaacctgggaggcaaaggttgcagtgagctgagatcgcgccactgcactccagcctggcaacagagcgagacaagactccatcttcaaaaaaaaaagtgagtgcccgatgatgccagattcttcatcacctgaagtgaacccacacaacagggctgggccatgggcatcataaaccccattttgcaagctcaggaggagctttagggaaatcagaagactggcccagtctctaccaagtggtggatttagagccggcatggcttcgttccaaatctcacccttgtcccaccattccatgggacctcccattcctgagggagcctggatacgggcaagtgcacaacccgggaggttgaggttacagtgagccatgatcgcaccactgcagtccagcccgagcaatagggtgagaccctccctctgaaaaaaataaaaatactcattttggaaggaagtcattctaaaatgttacacttgtcttcagcatatctgcaatataataattttctgcataactgaggatcattcacagaaaccaatggcttttctccagcagtgtcttctgaagttgtaacagtaggggcacggggagctatttgcttttatgctaaatgaccttagaccacttataaaatgcatatgagtgctttaaatgttattttgtgtgtgtgtggtgttgcctccctgactacaaggggtcacttgctactctaaatgtgtttctaatctactagtacaggaacacacatggacacgttaaaattgtgaataaaagtaagtaaaaagta

SEQ ID NO: 354744 - DNA, 3458 bp, Homo sapiens
acccgccccggctactccaacccctgggcgggcgggggtaccgcctgggcaagggccggggcgccgggccgagccacctcttcccctcccccgcttccctgtcgcgctccgctggctggacgcgctggaggagtggagcagcacccggccggccctgggggctgacagtcggcaaagtttggcccgaagaggaagtggtctcaaaccccggcaggtggcgaccaggccagaccaggggcgctcgctgcctgcgggcgggctgtaggcgagggcgcgccccagtgccgagacccggggcttcaggagccggccccgggagagaagagtgcggcggcggacggagaaaacaactccaaagttggcgaaaggcaccgcccctactcccgggctgccgccgcctccccgcccccagccctggcatccagagtacgggtcgagcccgggccatggagcccccctggggaggcggcaccagggagcctgggcgcccggggctccgccgcgaccccatcgggtagaccacagaagctccgggacccttccggcacctctggacagcccaggatgctgttggccaccctcctcctcctcctccttggaggcgctctggcccatccagaccggattatttttccaaatcatgcttgtgaggaccccccagcagtgctcttagaagtgcagggcaccttacagaggcccctggtccgggacagccgcacctcccctgccaactgcacctggctcatcctgggcagcaaggaacagactgtcaccatcaggttccagaagctacacctggcctgtggctcagagcgcttaaccctacgctcccctctccagccactgatctccctgtgtgaggcacctcccagccctctgcagctgcccgggggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctggtacgccgtctccgccgctggggcttgctccctcgaaccaacaccccggctcgggcctctgaggccagatcccaggtcacaccttctgctgctccccttgaggccctagatggtggcacaggtccagcccgtgagggcggggcagtgggtgggcaagatggggagcaggcacccccactgcccatcaaggctcccctcccatctgctagcacgtctccagcccccactactgtccctgaagccccagggccactgccctcactgcccctagagccatcactattgtctggagtggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtgggcctcccgttgaccctttatagcagctacatagggtcaacgggaggccctatgtagctgctataaagttaagtgtccctcaggcagggagagggctcacagagtctcctctgtacgtggccatggccagacaccccagtcccttcaccaccacctgctccccacgccaccaccatttgggtggctgtttttaaaaagtaaagttcttagaggaaaaaaaaaaaaaaaaaaaaacaacaaaaaaaaaaaaaaacaaaaaaacaaaaaaaagaagagggcggcggcggcgcatcacaaaagagatctaccctccgcgggggggccgccacgatctgtgagccgcgttccccccacgtgttgttctgtttgttccacacagacggggtggcccccccaacatgagtggcggactcgcttttttaactaggaccctcgatcgccgcgtgcgccgggcgcttgttttcaacacacggtccttgcgctcgtcgggacaacagatcgtcgtcctatcagcccgtgggggcacctccttcgtgcggacgacgagagcacacccccttactctgcggggggcaggcggcgacaccaacttggtgtgcggcccgacctcgtgctccctggtga

SEQ ID NO: 354745 - DNA, 2030 bp, Homo sapiens
acccgccccggctactccaacccctgggcgggcgggggtaccgcctgggcaagggccggggcgccgggccgagccacctcttcccctcccccgcttccctgtcgcgctccgctggctggacgcgctggaggagtggagcagcacccggccggccctgggggctgacagtcggcaaagtttggcccgaagaggaagtggtctcaaaccccggcaggtggcgaccaggccagaccaggggcgctcgctgcctgcgggcgggctgtaggcgagggcgcgccccagtgccgagacccggggcttcaggagccggccccgggagagaagagtgcggcggcggacggagaaaacaactccaaagttggcgaaaggcaccgcccctactcccgggctgccgccgcctccccgcccccagccctggcatccagagtacgggtcgagcccgggccatggagcccccctggggaggcggcaccagggagcctgggcgcccggggctccgccgcgaccccatcgggtagaccacagaagctccgggacccttccggcacctctggacagcccaggatgctgttggccaccctcctcctcctcctccttggaggcgctctggcccatccagaccggattatttttccaaatcatgcttgtgaggaccccccagcagtgctcttagaagtgcagggcaccttacagaggcccctggtccgggacagccgcacctcccctgccaactgcacctggctcatcctgggcagcaaggaacagactgtcaccatcaggttccagaagctacacctggcctgtggctcagagcgcttaaccctacgctcccctctccagccactgatctccctgtgtgaggcacctcccagccctctgcagctgcccgggggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacaggtcagtgggagtggggctggcagtagaagagtagaccctgag

SEQ ID NO: 354746 - DNA, 550 bp, Homo sapiens
acttaatataaatgacggactttaatacttctggatgattctgtgatctgttttgaaaaatacatgtatttttacaattttaggtttttattctaaatcatcaagtggattttctgatagtccttgggtaacttgtagcaagacccattttgttaacatagaatgactaggacctcatgtatcagctagaaaaagctattaaaaatgagagattcttttgttctatctggctgccacattttgagtcatttaagaaaatctttttcctaaattttaatttagtagtttcattaattattttggctagtaacactgacttgcctttttaatttaacttggttttccaaagtatcaaaacgaatgtcttttactaggaaatatgtgtattttttctcgttcagaatgttttttcatgtgtctagtccctactgcatcttctccttcatgttgcctggtatgtcatttcatgcagtaatagggagaatatacatttagttgtgtgaagtgatctattagaaaatattctgcatccagtttttggtaatctgtc

SEQ ID NO: 354747 - DNA, 351 bp, Homo sapiens
actaatttttttctgcaaatatactatttcaaatagccataatatgagagccccctataccctacaaaaaggtgtttgtggactgcactgctcagaatctttgtttaaatttcagtttgctggactggggcatggctgaccaatctttttaaattctactctccagtgactgatgggttactccatatattttttctcctacttaaaaacacatacacacacacttattttgttatagaataatatagggagcagtagaagacgttcaattgttttacagaatagaagatgacctctttagatggtttgtaagtaaaagtagtagacgcacaggttaagactggagaacaa

SEQ ID NO: 354748 - DNA, 737 bp, Homo sapiens
ctgcctggaaattttaatatagagattattttaaaagatatgggcagagtgtaggaagatcatagagataatgaaacactcccagacttgtaacctttactatccatagacctaatgaggcaagagaataaagcaattactaaagagaaaaagcaagcactgcgtagagggccacctaacaagagcaatgaccttcagctgagtgacaaaggcaggtgcacgatgactacaaaagtagagatctgggggaataaattatctaatcttactctcttcccactctctgatcccttgctagtgctccccaagggccaaaccaaatgaaagtcagaaggcaaggttgccaacagattttatccacagaggtcaggctcctagggcacagagcagagcaaagatgatggagaggatatatggtgaggcacacaaaagggatccagtttgatcatgtcaccctcccatataaaatccttcattctctatcttgattagagataatagtccttggctgggcacagtggcttatgcctgtaatcccaacactttgggaagttgaggcgggcagatcacttgaagtcaggagttcaagaccagcctggccaacatggtgaaacctcatctctactaaaaatacaaaaatcagctgggcgtggtggtgcgtgactgtaatctcagctatttaggaggctgaggcaggagaatcacttgaacccaggagacagaggttgcagtgaggc

SEQ ID NO: 354749 - DNA, 337 bp, Homo sapiens
aataaaattttgttaattatatataatccatttttaaaaacttagatgagtaaaaagcagtcggtctatgtgtatgtttatgaaaaagatatggttataggagcatggatgagagtatggaaggatttgcactgtttttaacagagtaagctgggcttggagagtagcagcaaaccaagagtctgcctttagaggccactgctttagaccctttcccccgatgcattgttaaattggaaagaaagagaagcggcctggcacagtggcccacgcctgtaatcccagcactttaagaggccgaggcagaaggatcatttgagtttaggagtttgagacc

SEQ ID NO: 354750 - DNA, 436 bp, Homo sapiens
ggatcttgctgggatgcccaggctggttgcaaactcctgagctcaagcaattctctccccttggcctcccataacactgggattaccggcatgagccattgtgtccagccattttgcctgttttttaaatgaggttatttgtggattttttgttgttgttcttattctcgttactttttacactgagggtgggactctatgggtgccagttctatgcaagcatttcgtatgagactcctgctctaaattggtttctgcaccctatgcagtcatccaggtagaagttcaagctctcagcacacagtttgagatgagtgctggctcagacccactaagctgtcagggtttctgccttctctttgcttctggccgctatggcagcctgaggatgcctctaacaagatgcgttttacattttctccagcattttagctgt

SEQ ID NO: 354751 - DNA, 330 bp, Homo sapiens
ttttttccaaagtcttatttctctttattattactatttttttacttctcttctgtttattgatttatacaagttgtcatcctaggacaaatttttgaggctttaaaaggtggatattattagacccaattttgacagatgatgaaactgaggcatagacaggttaaacgagttgtgcatgactgagtcacttactcttcacttggccaagcttttaaccattatacaatactgtctacacatgataacacattaaacacagtgttctatactttgctttttttcacctatcttagatattttcaaattcagtatataaacagttcattt

SEQ ID NO: 354752 - DNA, 413 bp, Homo sapiens
gcaccaccgcactccagcctgacagagcgagactccatctcaaaaaaaaagaaagaaaagcaaattctgctgcagacagtgggtatcgtgcaaatgaacaacaacttcctttgcatgctgtcactgctggtatcataggtatttgttacatatttaacacttcatatttgtaccacgctacaatggcaagtgtggcaaacacttatcgcccagtatatagtttcctttctcttcttagtaataaactcttggtttttagcttgctaataaatgatctaaggcttcctggtataaaaactacacttcccagcctcctttgcagttggccaggcaactaagtaggggacaacgggatggatgtagaactgtgactttcaggaaatgtctttaaagacagcaggggcctgtctttg

SEQ ID NO: 354753 - DNA, 3124 bp, Homo sapiens
tgcgtgtcttcgagaatgcgagattcataatgtttgctgtctatatgcatggctgagtacgtgcctcccgcgtacgtgcgtggtgtgcatacatgcgtgattgcgcgcccacgtacgttcttcgtgaaagggatgacgggagctgtatgaaagcggaagagttatagaccgctaacacctgtcactggccactggtttcccggagttagcggcaacgaccttgcagcctggacactagccaggcgctccctcttctcacagcggcccacgtctccttgcttgggagcccatcgtcctggctccggtggcctcgctgggtctcggggaagcagaggactgttcattcctgtggcgaaaagccggagtcggccctagacacccacgactcgcagggtccatggttccggaggccgtgagacctgccggggctgacaggtgccagggcccatgctgcgggagcctgtgtgctcagccttcttgcggacggtaaagaagctaagtggaagagtgtttcctcctctggccgtaaagcagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatgactggttagtgtttgaggctttgttctatgttttcccctgatttgttctggtcaaaactcatcaaatgtgtaactagcatccaggcgacaatacagaaagtctgggacctggcactgaatgtttgcctggtagtgactagccgttaatcaaccgactcatccaggatgaagaggacgtcagacttagagcagctgtctgtcctttcaggttactctcactcttctgaaagtgtctgtcagtttctgaagcatgtgtgttacctgcatcacacagctacttcctatcctagcaatacatccaaaatacagctctagtagagtgaggttaacttggaaatgtgatcagtagtgttgttttattttgtagtaatttttttttttttttggtgatttagcaaagtttctagttgttatccatgaggatgatgggcatttccccccaggtattgactgcagtggcccttctcttctgagccaggatgttatggtggttgtacatcccatggcagatggggtggcctgactttcaagtgggcctctttggaggcccctggatgctaggctagggatgctgagctgctgaccagacacttcctggcaacattgggagggacccatgaggaaacaatctcctgtttgaagatacaggaagatattgccggaatcaggcgtctattctttctcctgaccagcaggccaatctcaggggaccaggtcttcctgggcttggcctcgacacttcctagcaacatcctttgctgagtgtgtgaaaatgctgcttctccaaataaacgaggacaatggggaccaaagcctgtcttggacaggatttccagcctcccctggtttctgccaatgagatgtatataatatacaaggttaaaaaaaacacagacaacagttctcatttaaattgtttattatttatttccatggaattttgtttttctttattaagaccaaaaatgtgtttctcattaaaaaatggcaacttttatgggccattagtggcctgtgacttcacgaatttgcagtgtttctgaactgttcacagagtctacacttgtaatctgaggagccttcctactcctcctcatcgtcagagggctcatttggagacatgactgagagggaggccaacagagcatagtaacagatattgtacaaagacattacactaccattatctgagtaaaccagactactaagaatccctgtgccttccatccaggtagtagccgaagatgtaaatgtgacattcccagaggtgccctcccaacttgggccatttggttcctgagggggcccatttcccaggggatgcctagtggcactcttcttggaccacatgccagagcgcctgaaggactgggtgccactgggcccctgaacactgggggctccctgctgacacattttgattgcttctttcctggcattgatgtgatagatacgtagggagcgtcttgtagctaccagattctttctctttggagttgggacacgggtcgcttgctgagcggtgtttctgaggcatcctttctctggatattctccaggagcctgggcttgtctctctgaaaattggagttgcagtagatctaa

SEQ ID NO: 354754 - DNA, 3036 bp, Homo sapiens
tgcgtgtcttcgagaatgcgagattcataatgtttgctgtctatatgcatggctgagtacgtgcctcccgcgtacgtgcgtggtgtgcatacatgcgtgattgcgcgcccacgtacgttcttcgtgaaagggatgacgggagctgtatgaaagcggaagagttatagaccgctaacacctgtcactggccactggtttcccggagttagcggcaacgaccttgcagcctggacactagccaggcgctccctcttctcacagcggcccacgtctccttgcttgggagcccatcgtcctggctccggtggcctcgctgggtctcggggaagcagaggactgttcattcctgtggcgaaaagccggagtcggccctagacacccacgactcgcagggtccatggttccggaggccgtgagacctgccggggctgacaggtgccagggcccatgctgcgggagcctgtgtgctcagccttcttgcggacggtaaagaagctaagtggaagagtgtttcctcctctggccgtaaagcagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatgactggttagtgtttgaggctttgttctatgttttcccctgatttgttctggtcaaaactcatcaaatgtgtaactagcatccaggcgacaatacagaaagtctgggacctggcactgaatgtttgcctggtagtgactagccgttaatcaaccgactcatccaggatgaagaggacgtcagacttagagcagctgtctgtcctttcaggttactctcactcttctgaaagtgtctgtcagtttctgaagcatgtgtgttacctgcatcacacagctacttcctatcctagcaatacatccaaaatacagctctagtagagtgaggttaacttggaaatgtgatcagtagtgttgttttattttgtagtaatttttttttttttttggtgatttagcaaagtttctagttgttatccatgaggatgatgggcatttccccccaggtattgactgcagtggcccttctcttctgagccaggatgttatggtggttgtacatcccatggcagatggggtggcctgactttcaagtgggcctctttggaggcccctggatgctaggctagggatgctgagctgctgaccagacacttcctggcaacattgggagggacccatgaggaaacaatctcctgtttgaagatacaggaagatattgccggaatcaggcgtctattctttctcctgaccagcaggccaatctcaggggaccaggtcttcctgggcttggcctcgacacttcctagcaacatcctttgctgagtgtgtgaaaatgctgcttctccaaataaacgaggacaatggggaccaaagcctgtcttggacaggatttccagcctcccctggtttctgccaatgagatgtatataatatacaaggttaaaaaaaacacagacaacagttctcatttaaattgtttattatttatttccatggaattttgtttttctttattaagaccaaaaatgtgtttctcattaaaaaatggcaacttttatgggccattagtggcctgtgacttcacgaatttgcagtgtttctgaactgttcacagagtctacacttgtaatctgaggagccttcctactcctcctcatcgtcagagggctcatttggagacatgactgagagggaggccaacagagcatagtaacagatattgtacaaagacattacactaccattatctgagtaaaccagactactaagaatccctgtgccttccatccaggtagtagccgaagatgtaaatgtgacattcccagaggtgccctcccaacttgggccatttggttcctgagggggcccatttcccaggggatgcctagtggcactcttcttggaccacatgccagagcgcctgaaggactgggtgccactgggcccctgaacactgggggctccctgctgacacattttgattgcttctttcctggcattgatgtgatagatacgtagggagcgtcttgtagctaccagattctttctctttggagttgggacacgggtcgcttgctgagcggtgtttctgaggcatcctttctctggatattctccaggagcctgggcttgtctctctgaaaattggagttgcagtagatctaa

SEQ ID NO: 354755 - DNA, 3092 bp, Homo sapiens
tgcgtgtcttcgagaatgcgagattcataatgtttgctgtctatatgcatggctgagtacgtgcctcccgcgtacgtgcgtggtgtgcatacatgcgtgattgcgcgcccacgtacgttcttcgtgaaagggatgacgggagctgtatgaaagcggaagagttatagaccgctaacacctgtcactggccactggtttcccggagttagcggcaacgaccttgcagcctggacactagccaggcgctccctcttctcacagcggcccacgtctccttgcttgggagcccatcgtcctggctccggtggcctcgctgggtctcggggaagcagaggactgttcattcctgtggcgaaaagccggagtcggccctagacacccacgactcgcagggtccatggttccggaggccgtgagacctgccggggctgacaggtaaagaagctaagtggaagagtgtttcctcctctggccgtaaagcaggtactctctgcagcaccagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatgactggttagtgtttgaggctttgttctatgttttcccctgatttgttctggtcaaaactcatcaaatgtgtaactagcatccaggcgacaatacagaaagtctgggacctggcactgaatgtttgcctggtagtgactagccgttaatcaaccgactcatccaggatgaagaggacgtcagacttagagcagctgtctgtcctttcaggttactctcactcttctgaaagtgtctgtcagtttctgaagcatgtgtgttacctgcatcacacagctacttcctatcctagcaatacatccaaaatacagctctagtagagtgaggttaacttggaaatgtgatcagtagtgttgttttattttgtagtaatttttttttttttttggtgatttagcaaagtttctagttgttatccatgaggatgatgggcatttccccccaggtattgactgcagtggcccttctcttctgagccaggatgttatggtggttgtacatcccatggcagatggggtggcctgactttcaagtgggcctctttggaggcccctggatgctaggctagggatgctgagctgctgaccagacacttcctggcaacattgggagggacccatgaggaaacaatctcctgtttgaagatacaggaagatattgccggaatcaggcgtctattctttctcctgaccagcaggccaatctcaggggaccaggtcttcctgggcttggcctcgacacttcctagcaacatcctttgctgagtgtgtgaaaatgctgcttctccaaataaacgaggacaatggggaccaaagcctgtcttggacaggatttccagcctcccctggtttctgccaatgagatgtatataatatacaaggttaaaaaaaacacagacaacagttctcatttaaattgtttattatttatttccatggaattttgtttttctttattaagaccaaaaatgtgtttctcattaaaaaatggcaacttttatgggccattagtggcctgtgacttcacgaatttgcagtgtttctgaactgttcacagagtctacacttgtaatctgaggagccttcctactcctcctcatcgtcagagggctcatttggagacatgactgagagggaggccaacagagcatagtaacagatattgtacaaagacattacactaccattatctgagtaaaccagactactaagaatccctgtgccttccatccaggtagtagccgaagatgtaaatgtgacattcccagaggtgccctcccaacttgggccatttggttcctgagggggcccatttcccaggggatgcctagtggcactcttcttggaccacatgccagagcgcctgaaggactgggtgccactgggcccctgaacactgggggctccctgctgacacattttgattgcttctttcctggcattgatgtgatagatacgtagggagcgtcttgtagctaccagattctttctctttggagttgggacacgggtcgcttgctgagcggtgtttctgaggcatcctttctctggatattctccaggagcctgggcttgtctctctgaaaattggagttgcagtagatctaa

SEQ ID NO: 354756 - DNA, 3013 bp, Homo sapiens
aagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatggtgtcctccctcccaggagtggccctcaccttatcactggctgccaggtagggtgaccaacagtcccagtttgctgagtgaattgcagtgctaaaagccggcgagtcccagggaagcaggacgaattggtgagccgactgccagacccgtgaccagagtgaaggtgcagcgcagcgccatgcaggcagggtaaagaagctaagtggaagagtgtttcctcctctggccgtaaagcagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatgactggttagtgtttgaggctttgttctatgttttcccctgatttgttctggtcaaaactcatcaaatgtgtaactagcatccaggcgacaatacagaaagtctgggacctggcactgaatgtttgcctggtagtgactagccgttaatcaaccgactcatccaggatgaagaggacgtcagacttagagcagctgtctgtcctttcaggttactctcactcttctgaaagtgtctgtcagtttctgaagcatgtgtgttacctgcatcacacagctacttcctatcctagcaatacatccaaaatacagctctagtagagtgaggttaacttggaaatgtgatcagtagtgttgttttattttgtagtaatttttttttttttttggtgatttagcaaagtttctagttgttatccatgaggatgatgggcatttccccccaggtattgactgcagtggcccttctcttctgagccaggatgttatggtggttgtacatcccatggcagatggggtggcctgactttcaagtgggcctctttggaggcccctggatgctaggctagggatgctgagctgctgaccagacacttcctggcaacattgggagggacccatgaggaaacaatctcctgtttgaagatacaggaagatattgccggaatcaggcgtctattctttctcctgaccagcaggccaatctcaggggaccaggtcttcctgggcttggcctcgacacttcctagcaacatcctttgctgagtgtgtgaaaatgctgcttctccaaataaacgaggacaatggggaccaaagcctgtcttggacaggatttccagcctcccctggtttctgccaatgagatgtatataatatacaaggttaaaaaaaacacagacaacagttctcatttaaattgtttattatttatttccatggaattttgtttttctttattaagaccaaaaatgtgtttctcattaaaaaatggcaacttttatgggccattagtggcctgtgacttcacgaatttgcagtgtttctgaactgttcacagagtctacacttgtaatctgaggagccttcctactcctcctcatcgtcagagggctcatttggagacatgactgagagggaggccaacagagcatagtaacagatattgtacaaagacattacactaccattatctgagtaaaccagactactaagaatccctgtgccttccatccaggtagtagccgaagatgtaaatgtgacattcccagaggtgccctcccaacttgggccatttggttcctgagggggcccatttcccaggggatgcctagtggcactcttcttggaccacatgccagagcgcctgaaggactgggtgccactgggcccctgaacactgggggctccctgctgacacattttgattgcttctttcctggcattgatgtgatagatacgtagggagcgtcttgtagctaccagattctttctctttggagttgggacacgggtcgcttgctgagcggtgtttctgaggcatcctttctctggatattctccaggagcctgggcttgtctctctgaaaattggagttgcagtagatctaa

SEQ ID NO: 354757 - DNA, 2827 bp, Homo sapiens
tgctggtatagcagctctgggcccaaaactcctgcctggtgtcctcgtcccacccttccacttactcttcctccctcccgttccttttcctccttccggttcttcgtcgaggctgccggtctcgaggtcccctggccttggcctggttggctggcgcgcatcagggccaggtaaagaagctaagtggaagagtgtttcctcctctggccgtaaagcaggtactctctgcagcaccagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatgactggttagtgtttgaggctttgttctatgttttcccctgatttgttctggtcaaaactcatcaaatgtgtaactagcatccaggcgacaatacagaaagtctgggacctggcactgaatgtttgcctggtagtgactagccgttaatcaaccgactcatccaggatgaagaggacgtcagacttagagcagctgtctgtcctttcaggttactctcactcttctgaaagtgtctgtcagtttctgaagcatgtgtgttacctgcatcacacagctacttcctatcctagcaatacatccaaaatacagctctagtagagtgaggttaacttggaaatgtgatcagtagtgttgttttattttgtagtaatttttttttttttttggtgatttagcaaagtttctagttgttatccatgaggatgatgggcatttccccccaggtattgactgcagtggcccttctcttctgagccaggatgttatggtggttgtacatcccatggcagatggggtggcctgactttcaagtgggcctctttggaggcccctggatgctaggctagggatgctgagctgctgaccagacacttcctggcaacattgggagggacccatgaggaaacaatctcctgtttgaagatacaggaagatattgccggaatcaggcgtctattctttctcctgaccagcaggccaatctcaggggaccaggtcttcctgggcttggcctcgacacttcctagcaacatcctttgctgagtgtgtgaaaatgctgcttctccaaataaacgaggacaatggggaccaaagcctgtcttggacaggatttccagcctcccctggtttctgccaatgagatgtatataatatacaaggttaaaaaaaacacagacaacagttctcatttaaattgtttattatttatttccatggaattttgtttttctttattaagaccaaaaatgtgtttctcattaaaaaatggcaacttttatgggccattagtggcctgtgacttcacgaatttgcagtgtttctgaactgttcacagagtctacacttgtaatctgaggagccttcctactcctcctcatcgtcagagggctcatttggagacatgactgagagggaggccaacagagcatagtaacagatattgtacaaagacattacactaccattatctgagtaaaccagactactaagaatccctgtgccttccatccaggtagtagccgaagatgtaaatgtgacattcccagaggtgccctcccaacttgggccatttggttcctgagggggcccatttcccaggggatgcctagtggcactcttcttggaccacatgccagagcgcctgaaggactgggtgccactgggcccctgaacactgggggctccctgctgacacattttgattgcttctttcctggcattgatgtgatagatacgtagggagcgtcttgtagctaccagattctttctctttggagttgggacacgggtcgcttgctgagcggtgtttctgaggcatcctttctctggatattctccaggagcctgggcttgtctctctgaaaattggagttgcagtagatctaa

SEQ ID NO: 354758 - DNA, 2808 bp, Homo sapiens
tgctggtatagcagctctgggcccaaaactcctgcctggtgtcctcgtcccacccttccacttactcttcctccctcccgttccttttcctccttccggttcttcgtcgaggctgccggtctcgaggtcccctggccttggcctggttggctggcgcgcatcagggccaggtaaagaagctaagtggaagagtgtttcctcctctggccgtaaagcagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatgactggttagtgtttgaggctttgttctatgttttcccctgatttgttctggtcaaaactcatcaaatgtgtaactagcatccaggcgacaatacagaaagtctgggacctggcactgaatgtttgcctggtagtgactagccgttaatcaaccgactcatccaggatgaagaggacgtcagacttagagcagctgtctgtcctttcaggttactctcactcttctgaaagtgtctgtcagtttctgaagcatgtgtgttacctgcatcacacagctacttcctatcctagcaatacatccaaaatacagctctagtagagtgaggttaacttggaaatgtgatcagtagtgttgttttattttgtagtaatttttttttttttttggtgatttagcaaagtttctagttgttatccatgaggatgatgggcatttccccccaggtattgactgcagtggcccttctcttctgagccaggatgttatggtggttgtacatcccatggcagatggggtggcctgactttcaagtgggcctctttggaggcccctggatgctaggctagggatgctgagctgctgaccagacacttcctggcaacattgggagggacccatgaggaaacaatctcctgtttgaagatacaggaagatattgccggaatcaggcgtctattctttctcctgaccagcaggccaatctcaggggaccaggtcttcctgggcttggcctcgacacttcctagcaacatcctttgctgagtgtgtgaaaatgctgcttctccaaataaacgaggacaatggggaccaaagcctgtcttggacaggatttccagcctcccctggtttctgccaatgagatgtatataatatacaaggttaaaaaaaacacagacaacagttctcatttaaattgtttattatttatttccatggaattttgtttttctttattaagaccaaaaatgtgtttctcattaaaaaatggcaacttttatgggccattagtggcctgtgacttcacgaatttgcagtgtttctgaactgttcacagagtctacacttgtaatctgaggagccttcctactcctcctcatcgtcagagggctcatttggagacatgactgagagggaggccaacagagcatagtaacagatattgtacaaagacattacactaccattatctgagtaaaccagactactaagaatccctgtgccttccatccaggtagtagccgaagatgtaaatgtgacattcccagaggtgccctcccaacttgggccatttggttcctgagggggcccatttcccaggggatgcctagtggcactcttcttggaccacatgccagagcgcctgaaggactgggtgccactgggcccctgaacactgggggctccctgctgacacattttgattgcttctttcctggcattgatgtgatagatacgtagggagcgtcttgtagctaccagattctttctctttggagttgggacacgggtcgcttgctgagcggtgtttctgaggcatcctttctctggatattctccaggagcctgggcttgtctctctgaaaattggagttgcagtagatctaa

SEQ ID NO: 354759 - DNA, 2952 bp, Homo sapiens
aagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatggtgtcctccctcccaggagtggccctcaccttatcactggctgccaggtagggtgaccaacagtcccagtttgctgagtgaattgcagtgctaaaagccggcgagtcccagggaagcaggacgaattggtaaagaagctaagtggaagagtgtttcctcctctggccgtaaagcagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatgactggttagtgtttgaggctttgttctatgttttcccctgatttgttctggtcaaaactcatcaaatgtgtaactagcatccaggcgacaatacagaaagtctgggacctggcactgaatgtttgcctggtagtgactagccgttaatcaaccgactcatccaggatgaagaggacgtcagacttagagcagctgtctgtcctttcaggttactctcactcttctgaaagtgtctgtcagtttctgaagcatgtgtgttacctgcatcacacagctacttcctatcctagcaatacatccaaaatacagctctagtagagtgaggttaacttggaaatgtgatcagtagtgttgttttattttgtagtaatttttttttttttttggtgatttagcaaagtttctagttgttatccatgaggatgatgggcatttccccccaggtattgactgcagtggcccttctcttctgagccaggatgttatggtggttgtacatcccatggcagatggggtggcctgactttcaagtgggcctctttggaggcccctggatgctaggctagggatgctgagctgctgaccagacacttcctggcaacattgggagggacccatgaggaaacaatctcctgtttgaagatacaggaagatattgccggaatcaggcgtctattctttctcctgaccagcaggccaatctcaggggaccaggtcttcctgggcttggcctcgacacttcctagcaacatcctttgctgagtgtgtgaaaatgctgcttctccaaataaacgaggacaatggggaccaaagcctgtcttggacaggatttccagcctcccctggtttctgccaatgagatgtatataatatacaaggttaaaaaaaacacagacaacagttctcatttaaattgtttattatttatttccatggaattttgtttttctttattaagaccaaaaatgtgtttctcattaaaaaatggcaacttttatgggccattagtggcctgtgacttcacgaatttgcagtgtttctgaactgttcacagagtctacacttgtaatctgaggagccttcctactcctcctcatcgtcagagggctcatttggagacatgactgagagggaggccaacagagcatagtaacagatattgtacaaagacattacactaccattatctgagtaaaccagactactaagaatccctgtgccttccatccaggtagtagccgaagatgtaaatgtgacattcccagaggtgccctcccaacttgggccatttggttcctgagggggcccatttcccaggggatgcctagtggcactcttcttggaccacatgccagagcgcctgaaggactgggtgccactgggcccctgaacactgggggctccctgctgacacattttgattgcttctttcctggcattgatgtgatagatacgtagggagcgtcttgtagctaccagattctttctctttggagttgggacacgggtcgcttgctgagcggtgtttctgaggcatcctttctctggatattctccaggagcctgggcttgtctctctgaaaattggagttgcagtagatctaa

SEQ ID NO: 354760 - DNA, 2926 bp, Homo sapiens
tgcgtgtcttcgagaatgcgagattcataatgtttgctgtctatatgcatggctgagtacgtgcctcccgcgtacgtgcgtggtgtgcatacatgcgtgattgcgcgcccacgtacgttcttcgtgaaagggatgacgggagctgtatgaaagcggaagagttatagaccgctaacacctgtcactggccactggtttcccggagttagcggcaacgaccttgcagcctggacactagccaggcgctccctcttctcacagcggcccacgtctccttgcttgggagcccatcgtcctggctccggtggcctcgctgggtctcggggaagcagaggactgttcattcctgtggcgaaaagccggagtcggccctagacacccacgactcgcagggtccatggttccggaggccgtgagacctgccggggctgacaggtaaagaagctaagtggaagagtgtttcctcctctggccgtaaagcaggtactctctgcagcaccagctgtccccgccctactccggaccgccccaaagactccatgggatggacctgagtcagccgaatcccagccccttcccttgggcctgctgtggtgctggacatcagtgacagacggaagcaggagaccatcaagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatgactggttagtgtttgaggctttgttctatgttttcccctgatttgttctggtcaaaactcatcaaatgtgtaactagcatccaggcgacaatacagaaagtctgggacctggcactgaatgtttgcctggtagtgactagccgttaatcaaccgactcatccaggatgaagaggacgtcagacttagagcagctgtctgtcctttcaggttactctcactcttctgaaagtgtctgtcagtttctgaagcatgtgtgttacctgcatcacacagctacttcctatcctagcaatacatccaaaatacagctctagtagagtgaggttaacttggaaatgtgatcagtagtgttgttttattttgtagtaatttttttttttttttggtgatttagcaaagtttctagttgttatccatgaggatgatgggcatttccccccaggtattgactgcagtggcccttctcttctgagccaggatgttatggtggttgtacatcccatggcagatggggtggcctgactttcaagtgggcctctttggaggcccctggatgctaggctagggatgctgagctgctgaccagacacttcctggcaacattgggagggacccatgaggaaacaatctcctgtttgaagatacaggaagatattgccggaatcaggcgtctattctttctcctgaccagcaggccaatctcaggggaccaggtcttcctgggcttggcctcgacacttcctagcaacatcctttgctgagtgtgtgaaaatgctgcttctccaaataaacgaggacaatggggaccaaagcctgtcttggacaggatttccagcctcccctggtttctgccaatgagatgtatataatatacaaggttaaaaaaaacacagacaacagttctcatttaaattgtttattatttatttccatggaattttgtttttctttattaagaccaaaaatgtgtttctcattaaaaaatggcaacttttatgggccattagtggcctgtgacttcacgaatttgcagtgtttctgaactgttcacagagtctacacttgtaatctgaggagccttcctactcctcctcatcgtcagagggctcatttggagacatgactgagagggaggccaacagagcatagtaacagatattgtacaaagacattacactaccattatctgagtaaaccagactactaagaatccctgtgccttccatccaggtagtagccgaagatgtaaatgtgacattcccagaggtgccctcccaacttgggccatttggttcctgagggggcccatttcccaggggatgcctagtggcactcttcttggaccacatgccagagcgcctgaaggactgggtgccactgggcccctgaacactgggggctccctgctgacacattttgattgcttctttcctggcattgatgtgatagatacgtagggagcgtcttgtagctaccagattctttctctttggagttgggacacgggtcgcttgctgagcggtgtttctgaggcatcctttctctggatattctccaggagcctgggcttgtctctctgaaaattggagttgcagtagatctaa

SEQ ID NO: 354761 - DNA, 2628 bp, Homo sapiens
atactttcaatcatcgggactgcgcttaacctgttagattagctgggcacgtggtccgtacgattagacatagcctcctctggaccgtaaagcagctgtccccgccctactccggaccgccccaaagactccatgggatggacctgagtcagccgaatcccagccccttccgctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatgactggttagtgtttgaggctttgttctatgttttcccctgatttgttctggtcaaaactcatcaaatgtgtaactagcatccaggcgacaatacagaaagtctgggacctggcactgaatgtttgcctggtagtgactagccgttaatcaaccgactcatccaggatgaagaggacgtcagacttagagcagctgtctgtcctttcaggttactctcactcttctgaaagtgtctgtcagtttctgaagcatgtgtgttacctgcatcacacagctacttcctatcctagcaatacatccaaaatacagctctagtagagtgaggttaacttggaaatgtgatcagtagtgttgttttattttgtagtaatttttttttttttttggtgatttagcaaagtttctagttgttatccatgaggatgatgggcatttccccccaggtattgactgcagtggcccttctcttctgagccaggatgttatggtggttgtacatcccatggcagatggggtggcctgactttcaagtgggcctctttggaggcccctggatgctaggctagggatgctgagctgctgaccagacacttcctggcaacattgggagggacccatgaggaaacaatctcctgtttgaagatacaggaagatattgccggaatcaggcgtctattctttctcctgaccagcaggccaatctcaggggaccaggtcttcctgggcttggcctcgacacttcctagcaacatcctttgctgagtgtgtgaaaatgctgcttctccaaataaacgaggacaatggggaccaaagcctgtcttggacaggatttccagcctcccctggtttctgccaatgagatgtatataatatacaaggttaaaaaaaacacagacaacagttctcatttaaattgtttattatttatttccatggaattttgtttttctttattaagaccaaaaatgtgtttctcattaaaaaatggcaacttttatgggccattagtggcctgtgacttcacgaatttgcagtgtttctgaactgttcacagagtctacacttgtaatctgaggagccttcctactcctcctcatcgtcagagggctcatttggagacatgactgagagggaggccaacagagcatagtaacagatattgtacaaagacattacactaccattatctgagtaaaccagactactaagaatccctgtgccttccatccaggtagtagccgaagatgtaaatgtgacattcccagaggtgccctcccaacttgggccatttggttcctgagggggcccatttcccaggggatgcctagtggcactcttcttggaccacatgccagagcgcctgaaggactgggtgccactgggcccctgaacactgggggctccctgctgacacattttgattgcttctttcctggcattgatgtgatagatacgtagggagcgtcttgtagctaccagattctttctctttggagttgggacacgggtcgcttgctgagcggtgtttctgaggcatcctttctctggatattctccaggagcctgggcttgtctctctgaaaattggagttgcagtagatctaa

SEQ ID NO: 354762 - DNA, 983 bp, Homo sapiens
tgcgtgtcttcgagaatgcgagattcataatgtttgctgtctatatgcatggctgagtacgtgcctcccgcgtacgtgcgtggtgtgcatacatgcgtgattgcgcgcccacgtacgttcttcgtgaaagggatgacgggagctgtatgaaagcggaagagttatagaccgctaacacctgtcactggccactggtttcccggagttagcggcaacgaccttgcagcctggacactagccaggcgctccctcttctcacagcggcccacgtctccttgcttgggagcccatcgtcctggctccggtggcctcgctgggtctcggggaagcagaggactgttcattcctgtggcgaaaagccggagtcggccctagacacccacgactcgcagggtccatggttccggaggccgtgagacctgccggggctgacaggtgccagggcccatgctgcgggagcctgtgtgctcagccttcttgcggacggtacctgagggctggggtttccctggatgtggggctgggaactcgtgcggggcgcgaccgaggcgccttttcctgtcccctgctgtcggcagggtctcggctccgctccttctaagcgcgtgtacccgcgacgtgcgtctgcgagtagaaagcccgtgtactgctccacacacagcggccccacctcagtccggtcttccctgcctcccgttggcccttctgctgtgagctcgcctggacctgaggccgggcggtgcacagctctgtggcctgtggcgccgtgctcagcgtgacctacccagaattaagctgaggacaatgggatttagagtcccaaacactcgccccgtgacaatgggaggggaagtgtcatttttctcccttcgaatggagcatgcttggctgcaagaatgctgctcaacatggtgaaatgattttctgccctgcgggctggtgcaccctgtggtccttgacccagacaggtgcggagggtccca

SEQ ID NO: 354763 - DNA, 416 bp, Homo sapiens
tgcgtgtcttcgagaatgcgagattcataatgtttgctgtctatatgcatggctgagtacgtgcctcccgcgtacgtgcgtggtgtgcatacatgcgtgattgcgcgcccacgtacgttcttcgtgaaagggatgacgggagctgtatgaaagcggaagagttatagaccgctaacacctgtcactggcctgtggcgccgtgctcagcgtgacctacccagaattaagctgaggacaatgggatttagagtcccaaacactcgccccgtgacaatgggaggggaagtgtcatttttctcccttcgaatggagcatgcttggctgcaagaatgctgctcaacatggtgaaatgattttctgccctgcgggctggtgcaccctgtggtccttgacccagacaggtgcggagggtccca

SEQ ID NO: 354764 - DNA, 3059 bp, Homo sapiens
tgcgtgtcttcgagaatgcgagattcataatgtttgctgtctatatgcatggctgagtacgtgcctcccgcgtacgtgcgtggtgtgcatacatgcgtgattgcgcgcccacgtacgttcttcgtgaaagggatgacgggagctgtatgaaagcggaagagttatagaccgctaacacctgtcactggccactggtttcccggagttagcggcaacgaccttgcagcctggacactagccaggcgctccctcttctcacagcggcccacgtctccttgcttgggagcccatcgtcctggctccggtggcctcgctgggtctcggggaagcagaggactgttcattcctgtggcgaaaagccggagtcggccctagacacccacgactcgcagggtccatggttccggaggccgtgagacctgccggggctgacaggtgccagggcccatgctgcgggagcctgtgtgctcagccttcttgcggacggtaaagaagctaagtggaagagtgtttcctcctctggccgtaaagcagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatgactggttagtgtttgaggctttgttctatgttttcccctgatttgttctggtcaaaactcatcaaatgtgtaactagcatccaggcgacaatacagaaagtctgggacctggcactgaatgtttgcctggtagtgactagccgttaatcaaccgactcatccaggatgaagaggacgtcagacttagagcagctgtctgtcctttcaggttactctcactcttctgaaagtgtctgtcagtttctgaagcatgtgtgttacctgcatcacacagctacttcctatcctagcaatacatccaaaatacagctctagtagagtgaggttaacttggaaatgtgatcagtagtgttgttttattttgtagtaatttttttttttttttggtgatttagcaaagtttctagttgttatccatgaggatgatgggcatttccccccaggtattgactgcagtggcccttctcttctgagccaggatgttatggtggttgtacatcccatggcagatggggtggcctgactttcaagtgggcctctttggaggcccctggatgctaggctagggatgctgagctgctgaccagacacttcctggcaacattgggagggacccatgaggaaacaatctcctgtttgaagatacaggaagatattgccggaatcaggcgtctattctttctcctgaccagcaggccaatctcaggggaccaggtcttcctgggcttggcctcgacacttcctagcaacatcctttgctgagtgtgtgaaaatgctgcttctccaaataaacgaggacaatggggaccaaagcctgtcttggacaggatttccagcctcccctggtttctgccaatgagatgtatataatatacaaggttaaaaaaaacacagacaacagttctcatttaaattgtttattatttatttccatggaattttgtttttctttattaagaccaaaaatgtgtttctcattaaaaaatggcaacttttatgggccattagtggcctgtgacttcacgaatttgcagtgtttctgaactgttcacagagtctacacttgtaatctgaggagccttcctactcctcctcatcgtcagagggctcatttggagacatgactgagagggaggccaacagagcatagtaacagatattgtacaaagacattacactaccattatctgagtaaaccagactactaagaatccctgtgccttccatccaggtagtagccgaagatgtaaatgtgacattcccagaggtgccctcccaacttgggccatttggttcctgagggggcccatttcccaggggatgcctagtggcactcttcttggaccacatgccagagcgcctgaaggactgggtgccactgggcccctgaacactgggggctccctgctgacacattttgattgcttctttcctggcattgatgtgatagatacgtagggagcgtcttgtagctaccagattctttctctttggagttgggacacgggtcgcttgctgagcggtgtttctgaggcatcctttctctggatattctccaggagcctgggcttgtctctctgaaaattggagttgcagtagatctaa

SEQ ID NO: 354765 - DNA, 3568 bp, Homo sapiens
tgcgtgtcttcgagaatgcgagattcataatgtttgctgtctatatgcatggctgagtacgtgcctcccgcgtacgtgcgtggtgtgcatacatgcgtgattgcgcgcccacgtacgttcttcgtgaaagggatgacgggagctgtatgaaagcggaagagttatagaccgctaacacctgtcactggccactggtttcccggagttagcggcaacgaccttgcagcctggacactagccaggcgctccctcttctcacagcggcccacgtctccttgcttgggagcccatcgtcctggctccggtggcctcgctgggtctcggggaagcagaggactgttcattcctgtggcgaaaagccggagtcggccctagacacccacgactcgcagggtccatggttccggaggccgtgagacctgccggggctgacaggtgccagggcccatgctgcgggagcctgtgtgctcagccttcttgcggacggtacctgagggctggggtttccctggatgtggggctgggaactcgtgcggggcgcgaccgaggcgccttttcctgtcccctgctgtcggcagggtctcggctccgctccttctaagcgcgtgtacccgcgacgtgcgtctgcgagtagaaagcccgtgtactgctccacacacagcggccccacctcagtccggtcttccctgcctcccgttggcccttctgctgtgagctcgcctggacctgaggccgggcggtgcacagctctgtggcctgtggcgccgtgctcagcgtgacctacccagaattaagctgaggacaatgggatttagagtcccaaacactcgccccgtgacaatgggaggggaagtgtcatttttctcccttcgaatggagcatgcttggctgcaagaatgctgctcaacatggtaaagaagctaagtggaagagtgtttcctcctctggccgtaaagcaggtactctctgcagcaccagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatgactggttagtgtttgaggctttgttctatgttttcccctgatttgttctggtcaaaactcatcaaatgtgtaactagcatccaggcgacaatacagaaagtctgggacctggcactgaatgtttgcctggtagtgactagccgttaatcaaccgactcatccaggatgaagaggacgtcagacttagagcagctgtctgtcctttcaggttactctcactcttctgaaagtgtctgtcagtttctgaagcatgtgtgttacctgcatcacacagctacttcctatcctagcaatacatccaaaatacagctctagtagagtgaggttaacttggaaatgtgatcagtagtgttgttttattttgtagtaatttttttttttttttggtgatttagcaaagtttctagttgttatccatgaggatgatgggcatttccccccaggtattgactgcagtggcccttctcttctgagccaggatgttatggtggttgtacatcccatggcagatggggtggcctgactttcaagtgggcctctttggaggcccctggatgctaggctagggatgctgagctgctgaccagacacttcctggcaacattgggagggacccatgaggaaacaatctcctgtttgaagatacaggaagatattgccggaatcaggcgtctattctttctcctgaccagcaggccaatctcaggggaccaggtcttcctgggcttggcctcgacacttcctagcaacatcctttgctgagtgtgtgaaaatgctgcttctccaaataaacgaggacaatggggaccaaagcctgtcttggacaggatttccagcctcccctggtttctgccaatgagatgtatataatatacaaggttaaaaaaaacacagacaacagttctcatttaaattgtttattatttatttccatggaattttgtttttctttattaagaccaaaaatgtgtttctcattaaaaaatggcaacttttatgggccattagtggcctgtgacttcacgaatttgcagtgtttctgaactgttcacagagtctacacttgtaatctgaggagccttcctactcctcctcatcgtcagagggctcatttggagacatgactgagagggaggccaacagagcatagtaacagatattgtacaaagacattacactaccattatctgagtaaaccagactactaagaatccctgtgccttccatccaggtagtagccgaagatgtaaatgtgacattcccagaggtgccctcccaacttgggccatttggttcctgagggggcccatttcccaggggatgcctagtggcactcttcttggaccacatgccagagcgcctgaaggactgggtgccactgggcccctgaacactgggggctccctgctgacacattttgattgcttctttcctggcattgatgtgatagatacgtagggagcgtcttgtagctaccagattctttctctttggagttgggacacgggtcgcttgctgagcggtgtttctgaggcatcctttctctggatattctccaggagcctgggcttgtctctctgaaaattggagttgcagtagatctaa

SEQ ID NO: 354766 - DNA, 3143 bp, Homo sapiens
tgcgtgtcttcgagaatgcgagattcataatgtttgctgtctatatgcatggctgagtacgtgcctcccgcgtacgtgcgtggtgtgcatacatgcgtgattgcgcgcccacgtacgttcttcgtgaaagggatgacgggagctgtatgaaagcggaagagttatagaccgctaacacctgtcactggccactggtttcccggagttagcggcaacgaccttgcagcctggacactagccaggcgctccctcttctcacagcggcccacgtctccttgcttgggagcccatcgtcctggctccggtggcctcgctgggtctcggggaagcagaggactgttcattcctgtggcgaaaagccggagtcggccctagacacccacgactcgcagggtccatggttccggaggccgtgagacctgccggggctgacaggtgccagggcccatgctgcgggagcctgtgtgctcagccttcttgcggacggtaaagaagctaagtggaagagtgtttcctcctctggccgtaaagcaggtactctctgcagcaccagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatgactggttagtgtttgaggctttgttctatgttttcccctgatttgttctggtcaaaactcatcaaatgtgtaactagcatccaggcgacaatacagaaagtctgggacctggcactgaatgtttgcctggtagtgactagccgttaatcaaccgactcatccaggatgaagaggacgtcagacttagagcagctgtctgtcctttcaggttactctcactcttctgaaagtgtctgtcagtttctgaagcatgtgtgttacctgcatcacacagctacttcctatcctagcaatacatccaaaatacagctctagtagagtgaggttaacttggaaatgtgatcagtagtgttgttttattttgtagtaatttttttttttttttggtgatttagcaaagtttctagttgttatccatgaggatgatgggcatttccccccaggtattgactgcagtggcccttctcttctgagccaggatgttatggtggttgtacatcccatggcagatggggtggcctgactttcaagtgggcctctttggaggcccctggatgctaggctagggatgctgagctgctgaccagacacttcctggcaacattgggagggacccatgaggaaacaatctcctgtttgaagatacaggaagatattgccggaatcaggcgtctattctttctcctgaccagcaggccaatctcaggggaccaggtcttcctgggcttggcctcgacacttcctagcaacatcctttgctgagtgtgtgaaaatgctgcttctccaaataaacgaggacaatggggaccaaagcctgtcttggacaggatttccagcctcccctggtttctgccaatgagatgtatataatatacaaggttaaaaaaaacacagacaacagttctcatttaaattgtttattatttatttccatggaattttgtttttctttattaagaccaaaaatgtgtttctcattaaaaaatggcaacttttatgggccattagtggcctgtgacttcacgaatttgcagtgtttctgaactgttcacagagtctacacttgtaatctgaggagccttcctactcctcctcatcgtcagagggctcatttggagacatgactgagagggaggccaacagagcatagtaacagatattgtacaaagacattacactaccattatctgagtaaaccagactactaagaatccctgtgccttccatccaggtagtagccgaagatgtaaatgtgacattcccagaggtgccctcccaacttgggccatttggttcctgagggggcccatttcccaggggatgcctagtggcactcttcttggaccacatgccagagcgcctgaaggactgggtgccactgggcccctgaacactgggggctccctgctgacacattttgattgcttctttcctggcattgatgtgatagatacgtagggagcgtcttgtagctaccagattctttctctttggagttgggacacgggtcgcttgctgagcggtgtttctgaggcatcctttctctggatattctccaggagcctgggcttgtctctctgaaaattggagttgcagtagatctaa

SEQ ID NO: 354767 - DNA, 1686 bp, Homo sapiens
tgcgtgtcttcgagaatgcgagattcataatgtttgctgtctatatgcatggctgagtacgtgcctcccgcgtacgtgcgtggtgtgcatacatgcgtgattgcgcgcccacgtacgttcttcgtgaaagggatgacgggagctgtatgaaagcggaagagttatagaccgctaacacctgtcactggccactggtttcccggagttagcggcaacgaccttgcagcctggacactagccaggcgctccctcttctcacagcggcccacgtctccttgcttgggagcccatcgtcctggctccggtggcctcgctgggtctcggggaagcagaggactgttcattcctgtggcgaaaagccggagtcggccctagacacccacgactcgcagggtccatggttccggaggccgtgagacctgccggggctgacaggtgccagggcccatgctgcgggagcctgtgtgctcagccttcttgcggacggtaaagaagctaagtggaagagtgtttcctcctctggccgtaaagcagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccagaatccatagaggttcagctggcgaatgaaactcgtcaagctgtctgttttgaagatcctctctgcacctttccgttgaagaacctccctctggaagagatccttgtcgatgatcacggcgtctccatcatcgttccagctcacagacttgaatgtgtcttcctccacaatcgtccaaagctttcttgggaaggagagcctaaaaaggttgtggttgtcttccacgttgaccacgcgttggtttcggtcttctggtggtgagttatcttgggagcctggatcttggctcatggcttggtcctcgtgcctgtccaaaacctcgctggaatctggatttggatcaggtgaagaaccagatgggcccccgcttgttggctctccaccaacagatggggccagcttggcttcatattcctgttcagtgttctgactcgccatggagctacaccagaatcaggagcattttgtacccaaggcccttatcactgtcctagcaagtccaaaatgccttcagtcagagtaggcgtgcccaataaatactgtccacaaaaaaaaaaaa

SEQ ID NO: 354768 - DNA, 2640 bp, Homo sapiens
tcggctaggtacgaggctgggtgtggcgggagcctgtgtgctcagccttcttgcggacggtaaagaagctaagtggaagagtgtttcctcctctggccgtaaagcagctgtccccgccctactccggaccgccccaaagactccatgggatggacctgagtcagccgaatcccagccccttccgctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatgactggttagtgtttgaggctttgttctatgttttcccctgatttgttctggtcaaaactcatcaaatgtgtaactagcatccaggcgacaatacagaaagtctgggacctggcactgaatgtttgcctggtagtgactagccgttaatcaaccgactcatccaggatgaagaggacgtcagacttagagcagctgtctgtcctttcaggttactctcactcttctgaaagtgtctgtcagtttctgaagcatgtgtgttacctgcatcacacagctacttcctatcctagcaatacatccaaaatacagctctagtagagtgaggttaacttggaaatgtgatcagtagtgttgttttattttgtagtaatttttttttttttttggtgatttagcaaagtttctagttgttatccatgaggatgatgggcatttccccccaggtattgactgcagtggcccttctcttctgagccaggatgttatggtggttgtacatcccatggcagatggggtggcctgactttcaagtgggcctctttggaggcccctggatgctaggctagggatgctgagctgctgaccagacacttcctggcaacattgggagggacccatgaggaaacaatctcctgtttgaagatacaggaagatattgccggaatcaggcgtctattctttctcctgaccagcaggccaatctcaggggaccaggtcttcctgggcttggcctcgacacttcctagcaacatcctttgctgagtgtgtgaaaatgctgcttctccaaataaacgaggacaatggggaccaaagcctgtcttggacaggatttccagcctcccctggtttctgccaatgagatgtatataatatacaaggttaaaaaaaacacagacaacagttctcatttaaattgtttattatttatttccatggaattttgtttttctttattaagaccaaaaatgtgtttctcattaaaaaatggcaacttttatgggccattagtggcctgtgacttcacgaatttgcagtgtttctgaactgttcacagagtctacacttgtaatctgaggagccttcctactcctcctcatcgtcagagggctcatttggagacatgactgagagggaggccaacagagcatagtaacagatattgtacaaagacattacactaccattatctgagtaaaccagactactaagaatccctgtgccttccatccaggtagtagccgaagatgtaaatgtgacattcccagaggtgccctcccaacttgggccatttggttcctgagggggcccatttcccaggggatgcctagtggcactcttcttggaccacatgccagagcgcctgaaggactgggtgccactgggcccctgaacactgggggctccctgctgacacattttgattgcttctttcctggcattgatgtgatagatacgtagggagcgtcttgtagctaccagattctttctctttggagttgggacacgggtcgcttgctgagcggtgtttctgaggcatcctttctctggatattctccaggagcctgggcttgtctctctgaaaattggagttgcagtagatctaa

SEQ ID NO: 354769 - DNA, 1163 bp, Homo sapiens
tgcgtgtcttcgagaatgcgagattcataatgtttgctgtctatatgcatggctgagtacgtgcctcccgcgtacgtgcgtggtgtgcatacatgcgtgattgcgcgcccacgtacgttcttcgtgaaagggatgacgggagctgtatgaaagcggaagagttatagaccgctaacacctgtcactggccactggtttcccggagttagcggcaacgaccttgcagcctggacactagccaggcgctccctcttctcacagcggcccacgtctccttgcttgggagcccatcgtcctggctccggtggcctcgctgggtctcggggaagcagaggactgttcattcctgtggcgaaaagccggagtcggccctagacacccacgactcgcagggtccatggttccggaggccgtgagacctgccggggctgacaggtgccagggcccatgctgcgggagcctgtgtgctcagccttcttgcggacggtaaagaagctaagtggaagagtgtttcctcctctggccgtaaagcagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctgg

SEQ ID NO: 354770 - DNA, 433 bp, Homo sapiens
catggtaaattttttttttttttttttgagacgggtctcgctgtgtcacccaggctggagtgcagtggcgcaatctcggctccctgcaacctctgcctcccaggttcaagtgattctcctgcctcagcctctcgaatagctgggaccacaggcgggtgccgatggtggatgttttaatgatgacgttgatggtactgacactgatattactatttctttcccaacaatcttggaacaaggatgtacacaatgcatagtacccaggggcactctgtcactcaaaaccaggttttgggataatatatgaagttgggcattctatttaggttaaagattgtggataaaattgatatcatcatcatcatcatcattattcaccttctccccagtcatgtaaaagtaatggataagaacatcacttagacaaataatt

SEQ ID NO: 354771 - DNA, 367 bp, Homo sapiens
tggtcaaaataaggtaaatattgattatggatttaatccaaaactgtatagctacattgggaggatgaataaaagggaaattaggccgggtgcggtagctcacgcctgtaatcccagcactttgggaggccaaggcaggcggatcaccttaggtcaggagttcgagaccagcctggccaacatggtgaaaccctgtctgtactaaaaatacaaaaattagccgggcatggtggtgggcgcctgtaaatcccagctactcaggaggctgagtcaggagaatcccttgaacccagaagacggaggttgcagtgagccaagattgcaccactgcactccagcctgggtgacagagggagactccgtctca

SEQ ID NO: 354772 - DNA, 659 bp, Homo sapiens
aggcctcttattagggctctggtggcggcggcggcagacacttggggtctggacgcaacggaggcgggagcgtgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacagtgtgacctaaaggacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccgggccataaaagacaagcaggaaggaattgagtaggggccagagggggctctgctcggcctgtgagccccgttcctacctgtgcctgaccctccgctccaggtaccacaccgaggagagcggccggtcccagccatggcccgccttgtggccacccctcaccctgacaccgacgtgttggccacccctcaccctgacaccgacgtgtcctgtacatagattaggttttatattcctaataaagtatagcgggagagacctggaaaaaaa

SEQ ID NO: 354773 - DNA, 866 bp, Homo sapiens
aggcctcttattagggctctggtggcggcggcggcagacacttggggtctggacgcaacggaggcgggagcgtgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacagtgtgacctaaaggacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggacgtgcctgcttccccttcgccttctgccgtgattgtcagtttcctgaggcctccccagccacgctttctgtacagcctgcagaactgtgagtcaattaaacctcttttcttcataaaaaaaaaaaaaaaaaaaaatttgtggggggggcggggccggaaaaaggttttaacaccacgtggtggggcgccgcgggcgccaagaggtgtaactggcgccctggccacagcgctgggcaaaaaagaaaccgggcaagacacaggggtgggttccccccccataaaagaaccgcgggggcacccgcggtgtcgacccgaacccaggggggttcgggggcagcgtggcttaacaccacggtccacggagtcgattacgccccccggggggggtcaggcaggcacagacccacacgcacacggaccacgccacaccgtcaggatcaacccgatgcatcatccactccgaacaaacacca

SEQ ID NO: 354774 - DNA, 850 bp, Homo sapiens
tgattctcctgtctcagcctcctgagtagctgggattacaggtgtgcaccactaccacttggctaatttttatacttttagtagagatggggtttcaccatattggccaggctggccttgaactcctgacctcagatgatccgcccgcctcggcctcccaaagtgctggggttacaggcgtgagccaccgcacccggcccccttccttcgtcttagtcaatcctatcccacctcttcttccaccagtcccctcacctgatggtcccaacacttcatcatccaccacctcctggagggggtaccccgaggtgctccgctggggactctgctcattctggcggtgcggttgacggctggtcgtgatctttcccgtaatctgtcccctcttacggaacctagtctccgttctgtccatggccttcttctggacactgctaggatccagaagagtatgttatcaattctcaagcctaggagaagtcaggagtggagaacagctctgagaagatactgttgtccaactgatctccaggcaccacggagtccggtccctccaatcaggaaggtcggaatctctgatgtcatcgttcatgccaacctggcaaccagtttgaaaaaaaaacacatgtaactgccaggctgatctcttgtcctggagatcctgggtgaatggtatctcctgccactgtcccaacctcagaccattgtccaaaagcatcttcagggactccacatccctctgttccctgtcccagcagaggctgtgtcctctccactcaaagcctgaagcatgttggggtctcttcgtctctgtacgtgcccatttcagagtccagtctggtgggagagg

SEQ ID NO: 354775 - DNA, 317 bp, Homo sapiens
gttgttgttgttgagaaacagttccagcctgggcaacaagagcaaaactccatctcaaaaaaaataaagaacctgcgagtgagttcccacacgttttcctgatgggctgctgctttcctaggagtctctcgctcatagaaaaggcacaaactgaaagaggaagcagatcccattgctgtggaagtcccattgttaggaagctctgcttttgctggagtgcagtggcacgatcttggctcactgcaacctctgcctcctgggttcaagcgattctcctgcctcagcctcccaagtagctgggattacaggcatgtgcc

SEQ ID NO: 354776 - DNA, 355 bp, Homo sapiens
tccacctcagcctcccaaagtgttgggattacaggcacgagccaccacacctggccgggaggagacagggtttagactcagggtgggaggaggggagcccctgctcctcatctgtggcctctgtgtcttcctaggatcaccattaacaaggacaccaaggtacccaatgcctgtttattcaccatcaacaaagaagaccacacactgggaaacatcattaaatcgtaagtttcccgtcacaggctctcaggggctgtgtttaatgggcccctctgggcaaagcacaagttccaagtcttcctcagtctctctgagctacaggaagtccttctgggggcttgctctgggcatttta

SEQ ID NO: 354777 - DNA, 1894 bp, Homo sapiens
aggcctcttattagggctctggtggcggcggcggcagacacttggggtctggacgcaacggaggcgggagcgtgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacagtgtgacctaaaggacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccgggtgagggcggggcctggaggggcagacggggtgggctggacactggcccgtgtgcccaggcctgggacagccctggcctgtttcttcggaggtcctgggggagaggcggcggtgatggaagagcagggacttccaccacaggctccaggacatgtggactgaggggctgtggagtctgggcctgtggctcccgtctgccccatgggacttctgtagtgctgcagggtccctcgggtgctgtgggccagatcagggcggggacctactgtcctttgggggtgctcttctatgtcccttgtcggtgattggcaaggcctggtccttccaggcctctgggaggcagctcacaccagggtggcccacacctgttcctggcagggcgcctgggaatctagaacagtttagaggggaaagagccacagcaaagaaaagccgaggcagggtgatcacgaggtcaggagttcaagaccagcctggcaaacatggtgaagccctgtctctactaaaaatacaaaaattagctaggcatggtgtcatgtgctgtagtcccagctactcaggaggctgaggcaggagaatcgcttgaacccgggaggcggaggttgcggtgagccgagattgtgccactgcactccagcctaggtaacagagcaggactccatctcagtcaatcaatcaatcaatcaatctcagcggttgaactacccttgacatggttcagctctgtatccacacccaaatctcatgtcaaattgtaattcccagtgttgtgggagggacctggtgggaggtgattggctcatgggggccgacttcccccttgctgttctcgtgatattgagtgagcgcttgtgggatctggttgtttaaaagcttgcagccctcccacttcactctctctgtctctcctgctccaacatggccagacgtgcctgcttccccttcgccttctgccgtgattgtcagtttcctgaggcctccccagccacgctttctgtacagcctgcagaactctgccccagagcacatcagctatgtgccccagctctcaaacgacaccctggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccaggccagaggccagctccatgtcctccgtgttggcaatgatacccactgccaaccaacaaaaattggctgcaaccatcccctaccaggaccgagcccctacagggtgaagttcctggtgatgaatgacaaaggacccgtggctgaaacaaagtggtccagcaacactcgcctgcagcaagcccaggcacttcgggctgtccctggcccccagagcccgg

SEQ ID NO: 354778 - DNA, 1802 bp, Homo sapiens
tccacctcagcctcccaaagtgttgggattacaggcacgagccaccacacctggccgggaggagacagggtttagactcagggtgggaggaggggagcccctgctcctcatctgtggcctctgtgtcttcctaggatcaccattaacaaggacaccaaggtacccaatgcctgtttattcaccatcaacaaagaagaccacacactgggaaacatcattaaatcacagtgtgacctaaaggacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccgggtgagggcggggcctggaggggcagacggggtgggctggacactggcccgtgtgcccaggcctgggacagccctggcctgtttcttcggaggtcctgggggagaggcggcggtgatggaagagcagggacttccaccacaggctccaggacatgtggactgaggggctgtggagtctgggcctgtggctcccgtctgccccatgggacttctgtagtgctgcagggtccctcgggtgctgtgggccagatcagggcggggacctactgtcctttgggggtgctcttctatgtcccttgtcggtgattggcaaggcctggtccttccaggcctctgggaggcagctcacaccagggtggcccacacctgttcctggcagggcgcctgggaatctagaacagtttagaggggaaagagccacagcaaagaaaagccgaggcagggtgatcacgaggtcaggagttcaagaccagcctggcaaacatggtgaagccctgtctctactaaaaatacaaaaattagctaggcatggtgtcatgtgctgtagtcccagctactcaggaggctgaggcaggagaatcgcttgaacccgggaggcggaggttgcggtgagccgagattgtgccactgcactccagcctaggtaacagagcaggactccatctcagtcaatcaatcaatcaatcaatctcagcggttgaactacccttgacatggttcagctctgtatccacacccaaatctcatgtcaaattgtaattcccagtgttgtgggagggacctggtgggaggtgattggctcatgggggccgacttcccccttgctgttctcgtgatattgagtgagcgcttgtgggatctggttgtttaaaagcttgcagccctcccacttcactctctctgtctctcctgctccaacatggccagacgtgcctgcttccccttcgccttctgccgtgattgtcagtttcctgaggcctccccagccacgctttctgtacagcctgcagaactgtgagtcaattaaacctcttttcttcataaaaaaaaaaaaaaaaaaaaatttgtggggggggcggggccggaaaaaggttttaacaccacgtggtggggcgccgcgggcgccaagaggtgtaactggcgccctggccacagcgctgggcaaaaaagaaaccgggcaagacacaggggtgggttccccccccataaaagaaccgcgggggcacccgcggtgtcgacccgaacccaggggggttcgggggcagcgtggcttaacaccacggtccacggagtcgattacgccccccggggggggtcaggcaggcacagacccacacgcacacggaccacgccacaccgtcaggatcaacccgatgcatcatccactccgaacaaacacca

SEQ ID NO: 354779 - DNA, 642 bp, Homo sapiens
aggcctcttattagggctctggtggcggcggcggcagacacttggggtctggacgcaacggaggcgggagcgtgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacagtgtgacctaaaggacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccgggagtctctcgctcatagaaaaggcacaaactgaaagaggaagcagatcccattgctgtggaagtcccattgttaggaagctctgcttttctggagttcaaattcgcattcatgacgctttaaaccgtcagagctgggtgggtcctcctacaacaaaatcgtttgctctctctctcctagttaacaggctttcaaatattagaagatcaatgttctgaccccattaaaatttctcttttgtggaatgaaaa

SEQ ID NO: 354780 - DNA, 1265 bp, Homo sapiens
tcagcccccgactagcccgacagcccccgactagcccgacagcccccgactagcccgacagcacccatgggacttctgtagtgctgcagggtccctcgggtgctgtgggccagatcagggcggggacctactgtcctttgggggtgctcttctatgtcccttgtcggtgattggcaaggcctggtccttccaggcctctgggaggcagctcacaccagggtggcccacacctgttcctggcagggcgcctgggaatctagaacagtttagaggggaaagagccacagcaaagaaaagccgaggcagggtgatcacgaggtcaggagttcaagaccagcctggcaaacatggtgaagccctgtctctactaaaaatacaaaaattagctaggcatggtgtcatgtgctgtagtcccagctactcaggaggctgaggcaggagaatcgcttgaacccgggaggcggaggttgcggtgagccgagattgtgccactgcactccagcctaggtaacagagcaggactccatctcagtcaatcaatcaatcaatcaatctcagcggttgaactacccttgacatggttcagctctgtatccacacccaaatctcatgtcaaattgtaattcccagtgttgtgggagggacctggtgggaggtgattggctcatgggggccgacttcccccttgctgttctcgtgatattgagtgagcgcttgtgggatctggttgtttaaaagcttgcagccctcccacttcactctctctgtctctcctgctccaacatggccagacgtgcctgcttccccttcgccttctgccgtgattgtcagtttcctgaggcctccccagccacgctttctgtacagcctgcagaactgtgagtcaattaaacctcttttcttcataaaaaaaaaaaaaaaaaaaaatttgtggggggggcggggccggaaaaaggttttaacaccacgtggtggggcgccgcgggcgccaagaggtgtaactggcgccctggccacagcgctgggcaaaaaagaaaccgggcaagacacaggggtgggttccccccccataaaagaaccgcgggggcacccgcggtgtcgacccgaacccaggggggttcgggggcagcgtggcttaacaccacggtccacggagtcgattacgccccccggggggggtcaggcaggcacagacccacacgcacacggaccacgccacaccgtcaggatcaacccgatgcatcatccactccgaacaaacacca

SEQ ID NO: 354781 - DNA, 380 bp, Homo sapiens
gcgtgatctcagctcactgcaacctcttcctcccagtctcaagtgattctcctgtctcagcctcctgagtagctgggattacaggtgtgcaccactaccacttggctaatttttatacttttagtagagatggggtttcaccatattggccaggctggccttgaactcctgacctcagatgatccgcccgcctcggcctcccaaagtgctggggttacaggcgtgagccaccgcacccggcccccttccttcgtcttagtcaatcctatcccacctcttcttccaccagtcccctcacctgatggtcccaacacttcatcatccaccacctcctggagggggtaccccgaggtgctccgctggggactctgctcattctg

SEQ ID NO: 354782 - DNA, 968 bp, Homo sapiens
aggcctcttattagggctctggtggcggcggcggcagacacttggggtctggacgcaacggaggcgggagcgtgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacagtgtgacctaaaggacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggacgtgcctgcttccccttcgccttctgccgtgattgtcagtttcctgaggcctccccagccacgctttctgtacagcctgcagaactctgccccagagcacatcagctatgtgccccagctctcaaacgacaccctggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccaggccagaggccagctccatgtcctccgtgttggcaatgatacccactgccaaccaacaaaaattggctgcaaccatcccctaccaggaccgagcccctacagggtgaagttcctggtgatgaatgacaaaggacccgtggctgaaacaaagtggtccagcaacactcgcctgcagcaagcccaggcacttcgggctgtccctggcccccagagcccgg

SEQ ID NO: 354783 - DNA, 996 bp, Homo sapiens
aggcctcttattagggctctggtggcggcggcggcagacacttggggtctggacgcaacggaggcgggagcgtgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacagtgtgacctaaaggacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggtcccctcacctgatggtcccaacacttcatcatccaccacctcctggagggggtaccccgaggtgctccgctggggactctgctcattctggcggtgcggttgacggctggtcgtgatctttcccgtaatctgtcccctcttacggaacctagtctccgttctgtccatggccttcttctggacactgctaggatccagaagagtatgttatcaattctcaagcctaggagaagtcaggagtggagaacagctctgagaagatactgttgtccaactgatctccaggcaccacggagtccggtccctccaatcaggaaggtcggaatctctgatgtcatcgttcatgccaacctggcaaccagtttgaaaaaaaaacacatgtaactgccaggctgatctcttgtcctggagatcctgggtgaatggtatctcctgccactgtcccaacctcagaccattgtccaaaagcatcttcagggactccacatccctctgttccctgtcccagcagaggctgtgtcctctccactcaaagcctgaagcatgttggggtctcttcgtctctgtacgtgcccatttcagagtccagtctggtgggagagg

SEQ ID NO: 354784 - DNA, 1792 bp, Homo sapiens
aggcctcttattagggctctggtggcggcggcggcagacacttggggtctggacgcaacggaggcgggagcgtgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacagtgtgacctaaaggacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccgggtgagggcggggcctggaggggcagacggggtgggctggacactggcccgtgtgcccaggcctgggacagccctggcctgtttcttcggaggtcctgggggagaggcggcggtgatggaagagcagggacttccaccacaggctccaggacatgtggactgaggggctgtggagtctgggcctgtggctcccgtctgccccatgggacttctgtagtgctgcagggtccctcgggtgctgtgggccagatcagggcggggacctactgtcctttgggggtgctcttctatgtcccttgtcggtgattggcaaggcctggtccttccaggcctctgggaggcagctcacaccagggtggcccacacctgttcctggcagggcgcctgggaatctagaacagtttagaggggaaagagccacagcaaagaaaagccgaggcagggtgatcacgaggtcaggagttcaagaccagcctggcaaacatggtgaagccctgtctctactaaaaatacaaaaattagctaggcatggtgtcatgtgctgtagtcccagctactcaggaggctgaggcaggagaatcgcttgaacccgggaggcggaggttgcggtgagccgagattgtgccactgcactccagcctaggtaacagagcaggactccatctcagtcaatcaatcaatcaatcaatctcagcggttgaactacccttgacatggttcagctctgtatccacacccaaatctcatgtcaaattgtaattcccagtgttgtgggagggacctggtgggaggtgattggctcatgggggccgacttcccccttgctgttctcgtgatattgagtgagcgcttgtgggatctggttgtttaaaagcttgcagccctcccacttcactctctctgtctctcctgctccaacatggccagacgtgcctgcttccccttcgccttctgccgtgattgtcagtttcctgaggcctccccagccacgctttctgtacagcctgcagaactgtgagtcaattaaacctcttttcttcataaaaaaaaaaaaaaaaaaaaatttgtggggggggcggggccggaaaaaggttttaacaccacgtggtggggcgccgcgggcgccaagaggtgtaactggcgccctggccacagcgctgggcaaaaaagaaaccgggcaagacacaggggtgggttccccccccataaaagaaccgcgggggcacccgcggtgtcgacccgaacccaggggggttcgggggcagcgtggcttaacaccacggtccacggagtcgattacgccccccggggggggtcaggcaggcacagacccacacgcacacggaccacgccacaccgtcaggatcaacccgatgcatcatccactccgaacaaacacca

SEQ ID NO: 354785 - DNA, 1719 bp, Homo sapiens
gtgttactttccttgaagacttttgggaaaaaaagttgggggggatttttggctagaaagtctgttcttctgctctgatctggctgctacccagcttgggcatgaggctagaccctcacactgtctgtccctggacctcagacagtgtgacctaaaggacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccgggtgagggcggggcctggaggggcagacggggtgggctggacactggcccgtgtgcccaggcctgggacagccctggcctgtttcttcggaggtcctgggggagaggcggcggtgatggaagagcagggacttccaccacaggctccaggacatgtggactgaggggctgtggagtctgggcctgtggctcccgtctgccccatgggacttctgtagtgctgcagggtccctcgggtgctgtgggccagatcagggcggggacctactgtcctttgggggtgctcttctatgtcccttgtcggtgattggcaaggcctggtccttccaggcctctgggaggcagctcacaccagggtggcccacacctgttcctggcagggcgcctgggaatctagaacagtttagaggggaaagagccacagcaaagaaaagccgaggcagggtgatcacgaggtcaggagttcaagaccagcctggcaaacatggtgaagccctgtctctactaaaaatacaaaaattagctaggcatggtgtcatgtgctgtagtcccagctactcaggaggctgaggcaggagaatcgcttgaacccgggaggcggaggttgcggtgagccgagattgtgccactgcactccagcctaggtaacagagcaggactccatctcagtcaatcaatcaatcaatcaatctcagcggttgaactacccttgacatggttcagctctgtatccacacccaaatctcatgtcaaattgtaattcccagtgttgtgggagggacctggtgggaggtgattggctcatgggggccgacttcccccttgctgttctcgtgatattgagtgagcgcttgtgggatctggttgtttaaaagcttgcagccctcccacttcactctctctgtctctcctgctccaacatggccagacgtgcctgcttccccttcgccttctgccgtgattgtcagtttcctgaggcctccccagccacgctttctgtacagcctgcagaactgtgagtcaattaaacctcttttcttcataaaaaaaaaaaaaaaaaaaaatttgtggggggggcggggccggaaaaaggttttaacaccacgtggtggggcgccgcgggcgccaagaggtgtaactggcgccctggccacagcgctgggcaaaaaagaaaccgggcaagacacaggggtgggttccccccccataaaagaaccgcgggggcacccgcggtgtcgacccgaacccaggggggttcgggggcagcgtggcttaacaccacggtccacggagtcgattacgccccccggggggggtcaggcaggcacagacccacacgcacacggaccacgccacaccgtcaggatcaacccgatgcatcatccactccgaacaaacacca

SEQ ID NO: 354786 - DNA, 2041 bp, Homo sapiens
caacatttcagtgtcaagtggtccattagtagtctcttgacttacacacagaaagcctgtctgtattttttgtactcattggttagaaactacagcacattatttttcttcaagctgtattttatgtagaggaaaaacagttggtatatctgtgttgatgttgattcatatatattgggtattttatttatttttatagtaaaatgtattttgacaaatgtaaaatgaaaaggggaagatatctaaattcttgaatttgtttttataggagttccatctggaatatgacaaattagaagaacggcctcacctgccatccaccttcaactacaaccctgctcagcaagccttctaaaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctcaaaaaaaaaaaaaaaaaaaaaaaaaaaaaaaaaaaaaaaaaaaaaaaaaaaaaaaaaaaaaaccaacaaaacaaaaaaaaaaaaaaaaaaaagaaaaaaaaaagaaagaacaagaaggagccaacaaaaaaaaaagagaagcgacaaaaaagaaaacacacacaaacaacaaaaaaccaggacgaaacaaccacaaggggatgcgcctccacaaacaaccgcaacgcgtggaaaacattgagagaagcggcaccctaactattaggttgggaggctgggacacacgccccgcagcaccagccacaacacacgacacaagagcaacgagctgccaacccagacccagcagcgatcaactaactaacaccaacagtacagaagaacgagaaaccaaaaacgccgtcgacaacagacacagcaggtaaactacaaaagagccgccacctcgcacaggtcatcggtgtacacccaaaaacgactggacgccagacaccaaaaacccaagcatactacacacgacgaactccagccacacaagacagacctacaccgcagacgacaaccagagaaggacacccaacaaacacacactcagagagaacaagac

SEQ ID NO: 354787 - DNA, 598 bp, Homo sapiens
cacgtacagctgtacaaaaatattttcttcccttatattcatacttagcttttttctatttgaatttttttgtttttttactttttagatgtttttgttttgttgaaaactgatacacacactcatgtatttgcttaggtctatcaaggcatcactaggcaataggaatttttcagcttgtttataatcttacgggaccaccgttgtatatatggtccatcattgactgaaatgtcatgctgcacatgactgtcgtttattaaaatttttatttaccaaattaactttttaacatacgttgtaaccagtaatttcaatgtatttcgatataattgacatatcctctttgaaatttatagaaattgatttttatgtaccctaatttctctttcagggagaagatgggtatagtttaaccctttcatatcatccatccatccattcctactagttctgcctcagagtatatcctttattcaactactactcaccaccctattaggccatcattatctatcactggcctcctaatgcattttcctgctttcgttttataccctctttagcccattcctcatggagtagctaggacctttaa

SEQ ID NO: 354788 - DNA, 801 bp, Homo sapiens
ccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccagcctccagctctgagctttccaatccccagagtagcaaatgttgaaagaagttgcacagggagaagatgggtatagtttaaccctttcatatcatccatccatccattcctactagttctgcctcagagtatatcctttattcaactactactcaccaccctattaggccatcattatctatcactggcctcctaatgcattttcctgctttcgttttataccctctttagcccattcctcatggagtagctaggacctttaa

SEQ ID NO: 354789 - DNA, 707 bp, Homo sapiens
gaaagagtagtgctgctgtaactcaagttagtgtgacttttagaaaacttatagtattaaaaattaatttcatttctacagtttggttttatcgaattgtgatattctcttaagaaacatggaatatattatagaatgtttgttttatgtttttctgaagaatgagaaaatgttagattttcacatttatggtatgatttacagatttgtggagtgtaaatgcaatgctctgctctgttttctttatgctctaatataattaatttgtttctagatgctggcatcaccatctacatcaggtcagctgtctcagtttggggcaagtttatacgggcaacaaaacggaagtgaaaatgtgacaggattggacctttcagatttcccagcattagcagaccgaaacaggagggaaggaagtggtaacccaactccattaataaaccccttggctggaagagctccttatggtaattaagctttttaatgatggccagtagaaagtttccattgtatgtgcacacacatatacatttacatgtacgtatacatatgcttgtgtgtgtacacatgtatgtttgcattttctaatcaggttagtgtaattttttcagaattgatatattagaagtgatttttcttcccagaataccatgatagcaaagttaaatgggaaaactttgtacaaaaacccaagaggaagtcctcat

SEQ ID NO: 354790 - DNA, 3194 bp, Homo sapiens
ccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctca

SEQ ID NO: 354791 - DNA, 3800 bp, Homo sapiens
ccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctcaaaaaaaaaaaaaaaaaaaaaaaaaaaaaaaaaaaaaaaaaaaaaaaaaaaaaaaaaaaaaaccaacaaaacaaaaaaaaaaaaaaaaaaaagaaaaaaaaaagaaagaacaagaaggagccaacaaaaaaaaaagagaagcgacaaaaaagaaaacacacacaaacaacaaaaaaccaggacgaaacaaccacaaggggatgcgcctccacaaacaaccgcaacgcgtggaaaacattgagagaagcggcaccctaactattaggttgggaggctgggacacacgccccgcagcaccagccacaacacacgacacaagagcaacgagctgccaacccagacccagcagcgatcaactaactaacaccaacagtacagaagaacgagaaaccaaaaacgccgtcgacaacagacacagcaggtaaactacaaaagagccgccacctcgcacaggtcatcggtgtacacccaaaaacgactggacgccagacaccaaaaacccaagcatactacacacgacgaactccagccacacaagacagacctacaccgcagacgacaaccagagaaggacacccaacaaacacacactcagagagaacaagac

SEQ ID NO: 354792 - DNA, 3224 bp, Homo sapiens
ccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaaaaagattctcccttttctcttggggggttatgtggcctgtgtgtctctcagccaaaaatacctctcaaaattaactgtgcagaaaccgtgattgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctca

SEQ ID NO: 354793 - DNA, 3043 bp, Homo sapiens
ccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggacctttcagatttcccacattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctca

SEQ ID NO: 354794 - DNA, 3283 bp, Homo sapiens
ccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacataggtaggagaatctatttgtgtttagaccttttaaaaagaaatttacaattgagaatcagttaataaggcttttttcattttattatccagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctca

SEQ ID NO: 354795 - DNA, 3252 bp, Homo sapiens
ccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccagcctccagctctgagctttccaatccccagagtagcaaatgttgaaagaagttgcacaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctca

SEQ ID NO: 354796 - DNA, 3355 bp, Homo sapiens
ccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggctttggtatcaggatgatgctggcctcataaaatgaattagggaggattccctctttttctatttattggaatagtttcagaaggaatggtaccagctcctccttgtacctctggtagaattcggctgtgaatccatctggtcctggatttttttggttggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctca

SEQ ID NO: 354797 - DNA, 2678 bp, Homo sapiens
agtcagttaacttacatgaggctcaggttccttacctgtgtgtaaaatgggaacattgaactaggtgatctttaagatcccttccggctctaaaattgtttgacattatcttggtggtcagtaactgtgagaaacacattcctgaggaaaatttgcagctatagttgacttcaggacagcatgtttagggagtagaatgtaagctccctgagggtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctca

SEQ ID NO: 354798 - DNA, 2783 bp, Homo sapiens
ccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaaacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctca

SEQ ID NO: 354799 - DNA, 3084 bp, Homo sapiens
ccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccagagacagggtctcactatgttgcccaggcttgtcaagtgatcctcccacctcagcctctcaagatgctgggattacagagcggaagaatcccatcgtttatcatgttctggttggactttcttactgtttgctggagttgaacttcagagctatggcgtcaaccctgctgtaatatctcaggggagctcctagggtggggctggtgccatggctcaccctccaacctttccttcttcacttcagcctccagctctgagctttccaatccccagagtagcaaatgttgaaagaagttgcacaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaaacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctca

SEQ ID NO: 354800 - DNA, 2091 bp, Homo sapiens
ccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaagagttccatctggaatatgacaaattagaaggcttgctgagcagggttgtagttgaaggtggatg

SEQ ID NO: 354801 - DNA, 2394 bp, Homo sapiens
ccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggtatatttctttccatgtgcaaatgtataaatctaaacttgaaaaaagaagtgtcctcttttatctgtttataagtaccaatacatccagttccagtaatgtgccacatatttgccaactgtttaattccatctccttggcttgacactcttagaagagtgtcccaaaacaattggtttcactgatagttacattattgaatttggtaagaggttttgtaattttgcataagccttggtaacatttgaaatattttttgtgtctactgctttgtaaaataaagatactctcttgcaaccccagtcatatatttttatatttttgtaactttaagcaaggatgagatttttctaaaagcagtatataa

SEQ ID NO: 354802 - DNA, 2187 bp, Homo sapiens
gggacacttttaaggtttatttaaatgtgaaaatttgagactattgaacctatgttttacagtttggtaagcagttatgtttctaccttggggagagaaatgtaaagcaatcatctttcagacatctatttaaacaaactgaaaagccatttctttatgatttttgtattcatcatctgtgatttgctgaaagcatacaactgacttgtgaatcattcactgtcagatatagattcagtttaacattttttataagccgtctatatatttggcactctacaaggtgctttcatataccttcactcattttatttactttcttagtaaccctcataggtgtcattgtccacatttgacaagtaaagctaagagattttaaataactaggacacagtcatattaatgagtaataaaaccaggacttgaatacaagtcctagatctctgagcacaatgctattgttaggttcttttccccattgggtattaaatccttttagtggatcttgcttggaagtctttattgagcttttcttccagtcagcatatcaattagatgtatcagaaataattgtttaaatgacttcagtcatttaaatgaggaaattcccttttagaatcttaactacctatctgtgtaatcatgtaataacagttatctactacaaagtggggagtttctgtttatctctccattttttctttagtagtagcaactatatattaggatttgcagatttgttttatatttcagaataagttatttttctttttcctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctca

SEQ ID NO: 354803 - DNA, 1485 bp, Homo sapiens
gcagcccctactactactaaattggcggccgtacgtactgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctca

SEQ ID NO: 354804 - DNA, 1435 bp, Homo sapiens
caacatttcagtgtcaagtggtccattagtagtctcttgacttacacacagaaagcctgtctgtattttttgtactcattggttagaaactacagcacattatttttcttcaagctgtattttatgtagaggaaaaacagttggtatatctgtgttgatgttgattcatatatattgggtattttatttatttttatagtaaaatgtattttgacaaatgtaaaatgaaaaggggaagatatctaaattcttgaatttgtttttataggagttccatctggaatatgacaaattagaagaacggcctcacctgccatccaccttcaactacaaccctgctcagcaagccttctaaaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctca

SEQ ID NO: 354805 - DNA, 1321 bp, Homo sapiens
accgcccgcgccgcctccacccaagttcaggacaagagggagggagcgcttagctggctgcaataaaacttggccgatatggtgaagaccttctcttctatctctattacatgaatggaggagacgtattacaacttttagctgcagtggagctgagttccatctggaatatgacaaattagaagaacggcctcacctgccatccaccttcaactacaaccctgctcagcaagccttctaaaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctca

SEQ ID NO: 354806 - DNA, 1155 bp, Homo sapiens
gacacacaataagatgatccgcctctaccacccccccccacttcatcatccaaccccggtcatcaagccttctaaaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctca

SEQ ID NO: 354807 - DNA, 372 bp, Homo sapiens
cttacctgtgtgtaaaatgggaacattgaactaggtgatctttaagatcccttccggctctaaaattgtttgacattatcttggtggtcagtaactgtgagaaacacattcctgaggaaaatttgcagctatagttgacttcaggacagcatgtttagggagtagaatgtaagctccctgagggtaggggccttttctgttgtgttcactgccatatccccagcagctagcacaatgcgtgttacatagtaggcattcattaaatgtttgttgaatgaatgatgtgaaaagtatgttgatggtttgttaggagcacacctagaaagcctcaaagaaaaatggtgtgctttagggagggaaaagacagatttc

SEQ ID NO: 354808 - DNA, 457 bp, Homo sapiens
ttttaaacttagtactttgaattagtctgaaagatgaatctgggtttggccagtaatgaagaggtgaacagggagtcataatgttgaaactggacattcagatctttatagcatgatttccttatttttcaaagagcggaagaatcccatcgtttatcatgttctggttggactttcttactgtttgctggagttgaacttcagagctatggcgtcaaccctgctgtaatatctcaggggagctcctagggtggggctggtgccatggctcaccctccaacctttccttcttcacttcagcctccagctctgagctttccaatccccagagtagcaaatgttgaaagaagttgcacaggtaagtatgtggtggggaaagccgggggaaaaatggtactgtcatcagtattttgagggtggatgttgggccattttatcaatgagtcattttgttagt

SEQ ID NO: 354809 - DNA, 2488 bp, Homo sapiens
ccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaaaaagaattccccttttttgggggaatggggggtccccgcaaatttctccaaattagggggaaatggttggggcccagagcccgtgtgtgtaatccctaggggctctggccatgggttcccagacaaagaggcgccttggggggcccggccttaaataattgtgtgtggccaacacataaatgtggatgggtcctcacaatgagacggggcggaatttcctttattccctttggcgcaaaacaacttgcttgtacacacaatctggaggatgtccctgctcacaggtaaaggaacacagtcagattaccaatttgtggcggcctggtacaccagtcgttggactcgtatgaga

SEQ ID NO: 354810 - DNA, 5143 bp, Homo sapiens
  misc_feature (2491)..(2491): n is a, c, g, or t
  misc_feature (2962)..(2962): n is a, c, g, or t
  misc_feature (3144)..(3144): n is a, c, g, or t
ccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctgtatgttcaaagtattttaatcacttttgtattatagtggatcttgactatgctgaaaacatctttaagtgatgatggctatctttaaatggaactatttctccatcaagaaatttatttttacattattaaagtgaatttaatttagattaaaaccgtatcttaaccatggcttcataatctatatacctaaaaagaatttcaaacttaatgctgaagctgggtgcagtggctcacacttgtaatcccagcactttggtgaggtggacagatcacttgaggccagaagttagggacagcctgggcaacacagcaaaccacatttctacaaaaaataaaggaaaatattagctaggtgtggtggcacacatctatatagtcctagctacttgggaggctacagcaggaggatcgcttgagcccaggagtttgaggtgtcagtgagctatgattgtgccattgcactctagtggctgacagtgcaagaccctgtctctaaaaataactaataagtgccaaatttgtaagaagacagaattgacataactcatggatttggtgaatctaatttttgtaaatatgtgaattatatgatattcatgactatgntttttattccttgtggaaccatatgtataaataattcgatactgaatttaatcatttcataaacattattacttataagcaaggcagtgtgcatatttgttgtacgttttgaagtgctgattaaagtccacattttcattatcagcagtctattggccagtttaaacaaatattaatgtaaagaaattggttcattgatattttttccctgagcagttctgtatttacctgatgctctaaaattaagttttctgtcgttactcaaatgtacagttggcaacacattttgttatcaatagacaattatgtttactatagagtaaactattagtaattatttatgaccttatgattgggagaccttttcacaaatttaagtatttcataacatttctaataacatttctataaatggctttggatcaaatagtttaaagtatataattcagtatgttgataatgaattgtttngtttcatttcacaactgagaggatttttcccttatgtttttccttcatttttgtgagaatagagattattacctgttgttccttttaattgttcataagtaaataaatacattcaggcactcattcatctatcactggcagttctgttttcatattttatttatgtcttaaaaactacctcntgacgttggtaggaaagcatttctttacatggaggtttattttgtgggacattacctcctctggatgttacttcctcagtttacaagtagtgtaaattctcattgattcttttatgaattgtaatggattttctcttagcttttgagaatttagaatctgaaatttgaataaaaagtaaatatattcagtataatttttcaaaatgctctagtttcaagatagttaaaaaattatgtggaatttacataattaattcaaatatagtttgtatttagttccttatcaaataatgcaaatagttggagatacctcaatttcttttgagtgttaagaagagcaagaaaggagtgaagtttttgcaacacattgtgtctttatttggtctgcctatgtttttatcacattgcttataaaacttttaaaatccttgtttgtataaaaagtttctttagttaaataaaagtgtgtgtattaattagtgtgccttctggacaaattaagaaatattttttctatatttcaatgcggttgtatttaataacttataataaatgagtaggaagcattcatatttatttattttatgtgtaattttttttttccggaggaaagctttacaaaatgtagaacatgtttgatgtaagccacaggaaaaagttaattatcttttcttttaaaaattgaagttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctca

SEQ ID NO: 354811 - DNA, 3049 bp, Homo sapiens
ccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctgagttccatctggaatatgacaaattagaagaacggcctcacctgccatccaccttcaactacaaccctgctcagcaagccttctaaaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctca

SEQ ID NO: 354812 - DNA, 3127 bp, Homo sapiens
ccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatgtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctca

SEQ ID NO: 354813 - DNA, 3011 bp, Homo sapiens
ccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctca

SEQ ID NO: 354814 - DNA, 2716 bp, Homo sapiens
ccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctca

SEQ ID NO: 354815 - DNA, 4343 bp, Homo sapiens
  misc_feature (2491)..(2491): n is a, c, g, or t
  misc_feature (2962)..(2962): n is a, c, g, or t
  misc_feature (3144)..(3144): n is a, c, g, or t
ccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctgtatgttcaaagtattttaatcacttttgtattatagtggatcttgactatgctgaaaacatctttaagtgatgatggctatctttaaatggaactatttctccatcaagaaatttatttttacattattaaagtgaatttaatttagattaaaaccgtatcttaaccatggcttcataatctatatacctaaaaagaatttcaaacttaatgctgaagctgggtgcagtggctcacacttgtaatcccagcactttggtgaggtggacagatcacttgaggccagaagttagggacagcctgggcaacacagcaaaccacatttctacaaaaaataaaggaaaatattagctaggtgtggtggcacacatctatatagtcctagctacttgggaggctacagcaggaggatcgcttgagcccaggagtttgaggtgtcagtgagctatgattgtgccattgcactctagtggctgacagtgcaagaccctgtctctaaaaataactaataagtgccaaatttgtaagaagacagaattgacataactcatggatttggtgaatctaatttttgtaaatatgtgaattatatgatattcatgactatgntttttattccttgtggaaccatatgtataaataattcgatactgaatttaatcatttcataaacattattacttataagcaaggcagtgtgcatatttgttgtacgttttgaagtgctgattaaagtccacattttcattatcagcagtctattggccagtttaaacaaatattaatgtaaagaaattggttcattgatattttttccctgagcagttctgtatttacctgatgctctaaaattaagttttctgtcgttactcaaatgtacagttggcaacacattttgttatcaatagacaattatgtttactatagagtaaactattagtaattatttatgaccttatgattgggagaccttttcacaaatttaagtatttcataacatttctaataacatttctataaatggctttggatcaaatagtttaaagtatataattcagtatgttgataatgaattgtttngtttcatttcacaactgagaggatttttcccttatgtttttccttcatttttgtgagaatagagattattacctgttgttccttttaattgttcataagtaaataaatacattcaggcactcattcatctatcactggcagttctgttttcatattttatttatgtcttaaaaactacctcntgacgttggtaggaaagcatttctttacatggaggtttattttgtgggacattacctcctctggatgttacttcctcagtttacaagtagtgtaaattctcattgattcttttatgaattgtaatggattttctcttagcttttgagaatttagaatctgaaatttgaataaaaagtaaatatattcagtataatttttcaaaatgctctagtttcaagatagttaaaaaattatgtggaatttacataattaattcaaatatagtttgtatttagttccttatcaaataatgcaaatagttggagatacctcaatttcttttgagtgttaagaagagcaagaaaggagtgaagtttttgcaacacattgtgtctttatttggtctgcctatgtttttatcacattgcttataaaacttttaaaatccttgtttgtataaaaagtttctttagttaaataaaagtgtgtgtattaattagtgtgccttctggacaaattaagaaatattttttctatatttcaatgcggttgtatttaataacttataataaatgagtaggaagcattcatatttatttattttatgtgtaattttttttttccggaggaaagctttacaaaatgtagaacatgtttgatgtaagccacaggaaaaagttaattatcttttcttttaaaaattgaagttttaaccgtgattggagataccacaaagaagaacgagtatggattaccagggcaccaggcatggagccaacaatgaaaaccaatacctatgagaggggaacatattacttctttgactgtcttaactggaggaaagtagctaaggtatatttctttccatgtgcaaatgtataaatctaaacttgaaaaaagaagtgtcctcttttatctgtttataagtaccaatacatccagttccagtaatgtgccacatatttgccaactgtttaattccatctccttggcttgacactcttagaagagtgtcccaaaacaattggtttcactgatagttacattattgaatttggtaagaggttttgtaattttgcataagccttggtaacatttgaaatattttttgtgtctactgctttgtaaaataaagatactctcttgcaaccccagtcatatatttttatatttttgtaactttaagcaaggatgagatttttctaaaagcagtatataa

SEQ ID NO: 354816 - DNA, 1585 bp, Homo sapiens
  misc_feature (15)..(15): n is a, c, g, or t
  misc_feature (27)..(27): n is a, c, g, or t
  misc_feature (35)..(35): n is a, c, g, or t
ccgacccgggaggtnctctgcagggangtgcttancacttaggcctcatctgactctctgaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctca

SEQ ID NO: 354817 - DNA, 859 bp, Homo sapiens
cagatcagtttctgccaatttcagtggtttattgttcttagtatagttctttctctcttttttgttgaagttttaaacatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagtagttgaaaaaaaaaaagggggggggttaaaattcctcgggggcaaggtttgcgtcccagttctggtccaggtcctagggatcgatttaactaggaggcggttaaagtgaggaaacggctggactggaagactcttggggcaggcacaccaaatagcggaatactaggattaacgttcggggagggtta

SEQ ID NO: 354818 - DNA, 2427 bp, Homo sapiens
  misc_feature (1077)..(1077): n is a, c, g, or t
  misc_feature (1079)..(1079): n is a, c, g, or t
  misc_feature (1081)..(1081): n is a, c, g, or t
  misc_feature (1098)..(1098): n is a, c, g, or t
  misc_feature (1756)..(1756): n is a, c, g, or t
cacatttctcagaagcacaccattctgctctgcaaatatctttgtaggagaaattggaaattgacaaatacattcacttaaattttgctttgtgctgaaaattgaggaaaaatttaaattggccatttgcacattattagtagtaaatcaacccatgtaaagatggaaactatggtcatttcaaaagtgattttcatttttggtaagtgggtcctacagcattatgtcctcatatttgtgagttattgcaccctggctagtattttcattgctgccttatgtttatttgctgcaaatccctctcaaaactgtgtgcattggttataatgctaatgaggaagataattcaaactaaaattcaaatcataatagctttaggattttagagagatagtataaggttaactcattttcagcatgtgcagacttaattatgcatgggatgaaatacagtaggcaagtctcagcctaataataaataattgaaaaatataacctgtacaatatttaaactggctttaatattacttaattatcacattattctttttcattcatcatttcttttccaattctctcaccctaccattaagacagtaatgattttataagatgtagatccggtattaagttttgcttgctctactgtctcaaattattataacttctttgttattactggcttgtttctgtttgtctttcacaagtctttgactcagtagtagtagcaaatgacagagatcttcaagtgtcttaatgcttgtcaatataatattattccacttgataggatgtgtccccagatacattacagagtttaatcgttgatcactctgcccacagtctaattgtgataacaaactaatcgcagctgttacagagatgccagttaagtaatccgtgtttcagctgagtttctcaatggcagctttattttatagggccatctctgacgagattcatttggcagatatttttctaacaaatgttcgtcccagatgctgctagtatttaaacaggatatgctaagatttagatagaaatataaaatccttggatatttaaaacctagaattntnanataatcccatagaaagnacagtagttctgcatatgggaaagtgccttgtacttggtaaaataagttaaattttcaatatttacatgtcaaagagaacaaggactatctatatatgcaacatttatttttgcttatcatggttgaacaattgtcagcatcagtgctaacaccccatatgtgatgtatgtattttcactctctcccactcaaggtttttattgaactctaattagcagtttcttgcgtgtgaaattttgtagaacatttgctactcccagaagtcttgaaggtctaaaccagcaatgaaaaccactctgatttcctagatactgtgaagtaaaccaatttgatacttataagaaattatattcccccttaatgcttttcctacattttaatttcaaactaaggaaaggcacaaatttcacttttttatgtataatttattgcttggcatccctccaaatacaaatcctgtatgaataattacaacccctttcatgtttatatggttgctgctacaatgaacaggaaaataaagcaaaaggaatgaaaatgaatgtttgggtttcattatattgttaagtcagttttgtacattgaattatttagtatttaataataaatatctttagtaagttaatatgtgcctgatataaagaaaatgttaaggcnttcataagttaaagtcagaaatagcaaaacgaccagatggttagtaatcagattaaaacaaaacaaattacaatattatttttaaaagaattaagtggatttaaattacttccaaaatacttttgtttataggcaacaattaagagaaacaaagtgtaccagcacacagttaaactggcttttattcttcacttgagactagttctaattgatcactgtgctattgtatgatttgattgtgctgacagttacatgccactgttcccataataacaatttttcttctttgttcaaatgaattttctaattacacgtgtgatgggatgttttaattcttttcccttttcaaatccaccttcctgttgcaatgcatgatgggcaggctcaatattgtgcatgacacccgctacaagtgttggtaggtgccagctttgtttcttgattatcttaaacctatggtgtacctcacagcccctcaaaatccactgctaagtttaacttatatctattgggcaagtccatttcccttttactaacacttgtcaattaaatgccattttctgtttaattgacatggactcacataagtgttttctttacacacaacagtttcctttagtcacctttggtggattttgattggactatgagttctggtgtgtaaaaaaaat

SEQ ID NO: 354819 - DNA, 6491 bp, Homo sapiens
cccccagtctccaaaacttcatcacatcacagacgttcaggattctttccattcaaagcaaagccaagttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgactcagtcggctgtcaaatcactgaagcgacccctcgaggcaacctttgacctgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccagttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagta

SEQ ID NO: 354820 - DNA, 5643 bp, Homo sapiens
aactgcatgttgggtaaattcaaaacccacatgctcgtcctcttgcagtggaataagtcacatctgatggacattttctgtgcttatagcatagtaatgaacgtctgacaggcgcgacctttcataagacaacccacactattggctttctgcccagaatattgctgcaacactatctgtgattggttatctctctatcatgcattgcttcacaaggggaaacggcccctttttttaataaatctacgatggctggctgcaatatgcctcactgttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgactcagtcggctgtcaaatcactgaagcgacccctcgaggcaacctttgacctgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccagttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagta

SEQ ID NO: 354821 - DNA, 5433 bp, Homo sapiens
gaagtgctggtagtttgtctcaacccatgaagcagcttaacaagcaactattaaagcatagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgactcagtcggctgtcaaatcactgaagcgacccctcgaggcaacctttgacctgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccagttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagta

SEQ ID NO: 354822 - DNA, 6473 bp, Homo sapiens
cccccagtctccaaaacttcatcacatcacagacgttcaggattctttccattcaaagcaaagccaagttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggctcaatattgtgcatgacacccgctacaagtgttgttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagta

SEQ ID NO: 354823 - DNA, 6347 bp, Homo sapiens
cccccagtctccaaaacttcatcacatcacagacgttcaggattctttccattcaaagcaaagccaagttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgttcccatggtgcacggtgctacgccagccactgtgtccgcagcaacaacatctgccacaagtgttcccttcgctgcaacagccacagccaaccagccccatccttgatgcttctacactgttgggtgcaacatcctgtcctgcagcagcaggaaaaatgatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagta

SEQ ID NO: 354824 - DNA, 6418 bp, Homo sapiens
cccccagtctccaaaacttcatcacatcacagacgttcaggattctttccattcaaagcaaagccaagttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggctcaatattgtgcatgacacccgctacaagtgttgttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagta

SEQ ID NO: 354825 - DNA, 3459 bp, Homo sapiens
agcgcaagtgttcctttcgctgcaacagccacagccacccagatacccatacatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagta

SEQ ID NO: 354826 - DNA, 6058 bp, Homo sapiens
cccccagtctccaaaacttcatcacatcacagacgttcaggattctttccattcaaagcaaagccaagttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccagttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctacctgggttaggtctacctggggtactcgagctt

SEQ ID NO: 354827 - DNA, 1508 bp, Homo sapiens
tttagttaacattcttacactgtaatattaaatgatttatatttaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagta

SEQ ID NO: 354828 - DNA, 5867 bp, Homo sapiens
cccccagtctccaaaacttcatcacatcacagacgttcaggattctttccattcaaagcaaagccaagttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccagttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagaggccagatgatgtgagtgaagagccctaggatgaaatgaaagccttaaaagaatgaatgaattcacccaatcgttcagaaaaaggtggcaatactatagccagatacaagattaaaagacttgcccaaggtcacacagcaagctagtaggtcaagttccaacgcaccgcactcgggatcctgcagagacgaccacagcat

SEQ ID NO: 354829 - DNA, 1259 bp, Homo sapiens
  misc_feature (11)..(11): n is a, c, g, or t
taggaatgcgnaccaagcgctccgctgaatcctgaataatgcaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagta

SEQ ID NO: 354830 - DNA, 1306 bp, Homo sapiens
cttcttataatatctaggatctagatcttcttataataagatctagatcctaaattttattctaatatctaggatctagatcttcttataataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagta

SEQ ID NO: 354831 - DNA, 5780 bp, Homo sapiens
cccccagtctccaaaacttcatcacatcacagacgttcaggattctttccattcaaagcaaagccaagttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggctcaatattgtgcatgacacccgctacaagtgttgttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagta

SEQ ID NO: 354832 - DNA, 5685 bp, Homo sapiens
cccccagtctccaaaacttcatcacatcacagacgttcaggattctttccattcaaagcaaagccaagttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggctcaatattgtgcatgacacccgctacaagtgttgttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtttatgctgtgcataaactattcccccgagcaatctcaattacacatatacaccacaacatgttcaccagtactactactaatcacgcccataatcatacaagcccccgcaccataggtcctcccgatcatcctggtc

SEQ ID NO: 354833 - DNA, 4003 bp, Homo sapiens
cccccagtctccaaaacttcatcacatcacagacgttcaggattctttccattcaaagcaaagccaagttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaacagttgatggtgcactcgtagctgcaaaatgaaggacattaaatttggctgtgacattgagtggttacacagaagacctgcttctacaacatttggaaacattgtgaaacattactattcagttgctatttttccatctcaaaatatttttttttagttgctgctcacttatggccacagaacagtccctttttgagtaaagcagcaaggttgcttaatgacatgctatgtggttaacaagattcaactgccacatcaaggactttaaataatttcaagattttaaatgtatttatgaaatgaactcattacagcagctaatcaatgcaaactttgtcctttttctttgtctttctaagagaaactgaatttaatttaaatttaaattacagtgtctaaaacttggtaaaatattttaaatttgaataagaggaaaaaaaaaacatgaatttatttatgatggagcttcatacccaggacagtagcttcttaaatgttagtaaaataattatgttaagcattaaaacaattttgaatatgtaattaagcatttatgttaaaaaacatgtttcttacgtgtgtgtgtatatatttataactgacacatgtgattctttgtacagtatttagaatccttcccttcagatagcagtcctcttgtattcagtcttgtggctaaaatagatcaaaaacatattttaaaactgttaaagtaactgtatgactcatgcttgaagttctgaaatttgggagcgttatgaggtttccatgccattaaccgctagatcatttgcattctctcacagagtaaacggaaaaaaatttagaaaacttgtaataatcctgacttctttaataaaatgtgtcctgtgtattgcttaaatccatagtccagccttttctgagttcttgagccatgagatggaggtggcctgtgtaatctactatttttagaaagttaggaaagcaaaccaaatactctctgagaggaccctatgaaatggctgtacccttcagctgtgctgcttcagactttggccaggctcccaggtgacttacgttaatagcagacttctagttagaagaggagaatttatttcattaaaaaaaaaaaaataagtcaaacagttcaagaaagtattcatttatgtaaaagaagtcaattggtatgttactaaagataataggaagaaaattagctcactattttagttgcatactgatgattttaaggtttaaataattagatttaaatataccgtatgtaaatgtagaagtctgtatcgtaataaatctgttgctaagtaaaatgggaatacatgacaacgaggaatgtaggtattaagaatgtcagaattagaacgagaacagtaaaagagcaaaagctgtaataatgtgtgctagtatataaacaatactctaaatacttagtttctctaattttccttttacaattgcagttttaatttataatagtctaagagcgtattcaagctgagacttaaattgcttacgtgctatagatttaggtgtattagctatttcagaaatccagaacatttgcaaaggtgcattattttatgccaaagaggattatgttcccctatggcttgtgaaagagataggaaaaaagaaaagaaaaatattaacactgcaagccaccattagaaaattatatttcaaaaatgatgtttcaaatcaatgacaaattgcctattcagtcatgagctctcaactaaaatttggggagtcaatgtaaagaaagcctacagaatgtattttaatatttgccaagttatttataccctcaaaaaaaaagcttttacgatatgatcaacagaaatagacttattgtttactgaattctatttcaaatacccattcatttttcaggtactagggatgggagaaagagaat

SEQ ID NO: 354834 - DNA, 2177 bp, Homo sapiens
cccccagtctccaaaacttcatcacatcacagacgttcaggattctttccattcaaagcaaagccaagttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaagtgagtaactattatattcttttaaggatattcaatgattgaatgaggggtatatggacatacagttctctgcatatgagattaaggatagag

SEQ ID NO: 354835 - DNA, 1879 bp, Homo sapiens
cccccagtctccaaaacttcatcacatcacagacgttcaggattctttccattcaaagcaaagccaagttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagcttttttttttggggtcggtggcgatttaagggggggaccaggggggatcctcta

SEQ ID NO: 354836 - DNA, 399 bp, Homo sapiens
cttttagatattacctgttctaacaaagcttatctctttttcccttgtagatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatg

SEQ ID NO: 354837 - DNA, 6437 bp, Homo sapiens
cccccagtctccaaaacttcatcacatcacagacgttcaggattctttccattcaaagcaaagccaagttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccagttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagta

SEQ ID NO: 354838 - DNA, 6443 bp, Homo sapiens
cccccagtctccaaaacttcatcacatcacagacgttcaggattctttccattcaaagcaaagccaagttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgcctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgactcagtcggctgtcaaatcactgaagcgacccctcgaggcaacctttgacctgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccagttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagta

SEQ ID NO: 354839 - DNA, 6233 bp, Homo sapiens
cccccagtctccaaaacttcatcacatcacagacgttcaggattctttccattcaaagcaaagccaagttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccagttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagta

SEQ ID NO: 354840 - DNA, 6269 bp, Homo sapiens
cccccagtctccaaaacttcatcacatcacagacgttcaggattctttccattcaaagcaaagccaagttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggctcaatattgtgcatgacacccgctacaagtgttgttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagta

SEQ ID NO: 354841 - DNA, 6419 bp, Homo sapiens
cccccagtctccaaaacttcatcacatcacagacgttcaggattctttccattcaaagcaaagccaagttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggctcaatattgtgcatgacacccgctacaagtgttgttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagta

SEQ ID NO: 354842 - DNA, 6342 bp, Homo sapiens
cccccagtctccaaaacttcatcacatcacagacgttcaggattctttccattcaaagcaaagccaagttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagta

SEQ ID NO: 354843 - DNA, 5510 bp, Homo sapiens
cccccagtctccaaaacttcatcacatcacagacgttcaggattctttccattcaaagcaaagccaagttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagagggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggctcaatattgtgcatgacacccgctacaagtgttgttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagta

SEQ ID NO: 354844 - DNA, 6443 bp, Homo sapiens
cccccagtctccaaaacttcatcacatcacagacgttcaggattctttccattcaaagcaaagccaagttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccagttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagtaaaaaaaaaaagaaaaaaaaaaactttgtttcggggggcgtctggccccctcaaaaaagtttctccaaaccacttccttttgggggcggggccccaaatggtatgggcacactgggcaaagcgcggggtcccaaagaacaccccgggcctaacactagcgggtggtttctccccataaaaaagccggggggacccggggttttaaaatcca

SEQ ID NO: 354845 - DNA, 6294 bp, Homo sapiens
cccccagtctccaaaacttcatcacatcacagacgttcaggattctttccattcaaagcaaagccaagttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccagttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagtagtgaaaaaaacatcaaaaaaaactttttgggggcgcaccgggcctcaaaattttttaaaac

SEQ ID NO: 354846 - DNA, 5806 bp, Homo sapiens
cccccagtctccaaaacttcatcacatcacagacgttcaggattctttccattcaaagcaaagccaagttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggctcaatattgtgcatgacacccgctacaagtgttgttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagta

SEQ ID NO: 354847 - DNA, 5827 bp, Homo sapiens
cccccagtctccaaaacttcatcacatcacagacgttcaggattctttccattcaaagcaaagccaagttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggctcaatattgtgcatgacacccgctacaagtgttgttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaaaaaaaaaaaaaaaaaaaaaaaaaaaaaaaaaaaaaaaaaaagaaaaaaaaaaactttgtttcggggggcgtctggccccctcaaaaaagtttctccaaaccacttccttttgggggcggggccccaaatggtatgggcacactgggcaaagcgcggggtcccaaagaacaccccgggcctaacactagcgggtggtttctccccataaaaaagccggggggacccggggttttaaaatcca

SEQ ID NO: 354848 - DNA, 4052 bp, Homo sapiens
cccccagtctccaaaacttcatcacatcacagacgttcaggattctttccattcaaagcaaagccaagttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggctcaatattgtgcatgacacccgctacaagtgttgttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaaccctactgtgatcgttgcctgctgtggctgtggcaacagaggcatgcaggtgactgggggatgggcaggctgtgacctctaggcttggctggggagggcaggcacagccaaccatcacaacagaggtctgatgtcgacg

SEQ ID NO: 354849 - DNA, 1173 bp, Homo sapiens
attcctgagtctgtgactggtgctggagttttgagtccacagataaaatgtgtctccttcgtctctactagagaggaaaaagaactggaattggaagaacagggagactgaagggtagcaagagaggctggagaagagagtgaaaagaccgcttacctgatttgaaattgtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgtta

SEQ ID NO: 354850 - DNA, 1136 bp, Homo sapiens
attcctgagtctgtgactggtgctggagttttgagtccacagataaaatgtgtctccttcgtctctactagagaggaaaaagaactggaattggaagaacagggagactgaagggtagcaagagaggctggagaagagagtgaaaagaccgcttacctgatttgaaattgtctgcagcccctctttcctggagtaaatgaactggaccaaatctcaaaaatccacgatgtcatcggcacacccgctcagaagatcctcaccaagttcaaacaggatcaggaatacctctactaacaaccaatttgtccccacaatgcctctccctcctgcacgcaatggtggcctatgatcccgatgagagaatcgccgcccaccaggccctgcagcacccctacttccaagaacagagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgtta

SEQ ID NO: 354851 - DNA, 1839 bp, Homo sapiens
cgcatgcgcaggcgacagctcatggcgttcagggcctgacggttgctagggtgacagggacacaacatggcggcgggatctctaacgctctccttcgagggaccaccacggagatcctagtgcgggaccccgcctcagactataaagcaattggcaaaataggagagggaacgttttctgaagttatgaagatgcaaagcctgagagatggaaactactatgcatgtaaacaaatgaagcagcgctttgaaagtattgagcaagtcaacaacctacgagagatccaagcactgaggcgcctgaatccgcacccaaacattcttatgttgcatgaagtggtttttgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagaggaaaacagagaagcgggctctgggcagccacagaaaagctggctttccggagcaccctgtggcaccggaaccactcagtaacagctgccagatttccaaggagggcagaaagcagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgtta

SEQ ID NO: 354852 - DNA, 2264 bp, Homo sapiens
cgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagtattgagcaagtcaacaacctacgagagatccaagcactgaggcgcctgaatccgcacccaaacattcttatgttgcatgaagtggtttttgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacacgagagctatgaattttgattttcctttttaaaccaggcgatcaggaatacctctactaacaaccaatttgtccccacaatgcctctccctcctgcacgcaatggtgtgtttattatggtcgatgaaccgtggatatctcattactacacagagcccatcatttacatcaggggtccctcttggtggtgcacgttctgtgggctgggacaggtgtagactctgcagtcataaaccattccccaccacacagggcccttagttgtgacagtggaccaccggtgcgctcagtgacagcatgaccatttattatcattgggtttttaatacaggtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagaggaaaacagagaagcgggctctgggcagccacagaaaagctggctttccggagcaccctgtggcaccggaaccactcagtaacagctgccagatttccaaggagggcagaaagcagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgtta

SEQ ID NO: 354853 - DNA, 1819 bp, Homo sapiens
cgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagtgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaaggtagcgcggaaccagcttctctgacggcgctgctcttcgacccagcccaggccgccactgaattttgtgtctgtaatttttctttgacagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgtta

SEQ ID NO: 354854 - DNA, 1729 bp, Homo sapiens
cgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagtgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgtta

SEQ ID NO: 354855 - DNA, 1879 bp, Homo sapiens
cgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaaggcagttacctagaaacagaatcactgggtcaaaggtgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagaggaaaacagagaagcgggctctgggcagccacagaaaagctggctttccggagcaccctgtggcaccggaaccactcagtaacagctgccagatttccaaggagggcagaaagcagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgtta

SEQ ID NO: 354856 - DNA, 2101 bp, Homo sapiens
cgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagtattgagcaagtcaacaacctacgagagatccaagcactgaggcgcctgaatccgcacccaaacattcttatgttgcatgaagtggtttttgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaaggttgtaaaaaatggtttatttaataaatgccatcaacataactgactgcacctggaagaaaataattgaaagcaccattttcacaccgcagacaaaaatgaaccctattcagacggccgttcaaaccttctagagggaaatgtggcagaggcaggatttgagctcagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagaggaaaacagagaagcgggctctgggcagccacagaaaagctggctttccggagcaccctgtggcaccggaaccactcagtaacagctgccagatttccaaggagggcagaaagcagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgtta

SEQ ID NO: 354857 - DNA, 1773 bp, Homo sapiens
cgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagaggaaaacagagaagcgggctctgggcagccacagaaaagctggctttccggagcaccctgtggcaccggaaccactcagtaacagctgccagatttccaaggagggcagaaagcagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgtta

SEQ ID NO: 354858 - DNA, 1111 bp, Homo sapiens
taaaatatatatatatatatctataatatcgtatataataaaataaaaaaattcatctgcagcccctctttcctggagtaaatgaactggaccaaatctcaaaaatccacgatgtcatcggcacacccgctcagaagatcctcaccaagttcaaacaggatcaggaatacctctactaacaaccaatttgtccccacaatgcctctccctcctgcacgcaatggtggcctatgatcccgatgagagaatcgccgcccaccaggccctgcagcacccctacttccaagaacagagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaaggtagcgcggaaccagcttctctgacggcgctgctcttcgacccagcccaggccgccactgaattttgtgtctgtaatttttctttgacagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgtta

SEQ ID NO: 354859 - DNA, 1841 bp, Homo sapiens
cgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagtgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaaggtagcgcggaaccagcttctctgacggcgctgctcttcgacccagcccaggccgccactgaattttgtgtctgtaatttttctttgacagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgttatacagtattgcaaaaaaatgtt

SEQ ID NO: 354860 - DNA, 1908 bp, Homo sapiens
cgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagtgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagaggaaaacagagaagcgggctctgggcagccacagaaaagctggctttccggagcaccctgtggcaccggaaccactcagtaacagctgccagatttccaaggagggcagaaagcagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgttaaaaaaaacaacaaaaaaacaacaaaccaataccaaccacagaaaacacagagggacgcgtcaaa

SEQ ID NO: 354861 - DNA, 2672 bp, Homo sapiens
cgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagtgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagagaacccagaacggaagcgaggatgaggcctcagccgtcctcctccccattcaaacacgttcatccctcaaccctctgctgagcacctgcatgctgcccggccgcagtgtcacccttcttgtgtgagcctaccctcatccacccacctcaccctcctgaccttaaagaagacaccgggcagaagcacaggggagcccagtcacaccccacactggcgggggcaggccttgcagggagaagcagtaagcagccatctccatcagccatttccatctggcactcagacgtgcacgtcttcgtgtgacaggcggcagcagtgcgaccgtgacctcccatctgctctgctgtccccacacctgcggtgcagccagcctgccacaaggcagctagagtccagctagacccacccctggcacggccgacctcttcctggcttcttctgggcctaatccccgtgcattctccaacgccagaagtgtaagaaagtgcaaggcaacaagtgagaagagcaaacccaaatcgtaccagggaagctagtctttccagggcacctgagtgagggcatgaccagccttgacgctgcctcgctaccatctgcccagggcctgctgaatgcttgagtccatggtgacagtggtgggaacagttacgaggcagttagattttggaagtcatgttggcccacttggctacagagcagtcttaggaacagcaccataaaaataaagacttattcctgacacacatgcatctagagtaaactggggcgtatctgacagcgttagtacagtgatggccaaatgcaaactgcattccagaaccagcgaagggtgacagactgggctgaggcagagctaggactaaccatctcgagtgatgccatctcggggccaacaaaagttttggacacggctggatcatctgaccaaactgctcaaatctttacacaattattgtcctggtattaaactttcacctgccacttccaacaaacaggagacagaataaggagatgaccaggaagatggctggattaagaattctagacttggccgggtgcggtggctcacacctgtaatcctagcatcttgggaggctgaggcaggaggatcgcttgagcccaggagtttgagaccagcctaggcaacataaggagaccccatctctacaaaatatcaaaaaattacccaggtatggtggcacacacgtgtgattccagctactcgggaggctgagatgggaggatcacttgaacccaggaggttggggctacaatgagctatgatcgcaccacttcattccagcctggatgacagaagactcactccatagttcatggccccgtgatccagagtccctgctggcgccttcgagtggggcaggctgagaactcaagctgtaactaatgtctcctccgaagaaaactaaaccgagggctgagctgatgtgaagttttccgtggctgcattcatacaaatggtgaaaatgtagcatacctcccctcaaaagcctgaaagtaaagacatgcccccaatttaatgtgatgaattagagaaataggtttcagacacttcatggtttaaagtctcacaaaataaagctttcgaaggatccagttgtatatgattttttaaaaaaataaataaacattcttctgcttggtagctgcaca

SEQ ID NO: 354862 - DNA, 1358 bp, Homo sapiens
cgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagtgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagagaagactcactccatagttcatggccccgtgatccagagtccctgctggcgccttcgagtggggcaggctgagaactcaagctgtaactaatgtctcctccgaagaaaactaaaccgagggctgagctgatgtgaagttttccgtggctgcattcatacaaatggtgaaaatgtagcatacctcccctcaaaagcctgaaagtaaagacatgcccccaatttaatgtgatgaattagagaaataggtttcagacacttcatggtttaaagtctcacaaaataaagctttcgaaggatccagttgtatatgattttttaaaaaaataaataaacattcttctgcttggtagctgcaca

SEQ ID NO: 354863 - DNA, 350 bp, Homo sapiens
ggatcaggaatacctctactaacaaccaatttgtccccacaatgcctctccctcctgcacgcaatggtggcctatgatcccgatgagagaatcgccgcccaccaggccctgcagcacccctacttccaagaacagaggtaggcactctcgtgggttcggtggggcagatgcaggacctggcaaatgagacccatgggcacatggtggggcaaggtactgccccctggagggtccctggttcttgggaatcgcgctctctatcctgaagagtggtcagggcctcttggggcccacaccgtgctgccttctggtgtatcctccccaaaatgaggatgttagcagctccacgg

SEQ ID NO: 354864 - DNA, 1934 bp, Homo sapiens
cgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagtattgagcaagtcaacaacctacgagagatccaagcactgaggcgcctgaatccgcacccaaacattcttatgttgcatgaagtggtttttgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagaggaaaacagagaagcgggctctgggcagccacagaaaagctggctttccggagcaccctgtggcaccggaaccactcagtaacagctgccagatttccaaggagggcagaaagcagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgtta

SEQ ID NO: 354865 - DNA, 1844 bp, Homo sapiens
cgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagtgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagaggaaaacagagaagcgggctctgggcagccacagaaaagctggctttccggagcaccctgtggcaccggaaccactcagtaacagctgccagatttccaaggagggcagaaagcagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgtta

SEQ ID NO: 354866 - DNA, 2785 bp, Homo sapiens
cgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagtattgagcaagtcaacaacctacgagagatccaagcactgaggcgcctgaatccgcacccaaacattcttatgttgcatgaagtggtttttgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtaagtattgtgttctgagagtggatgtggacccactcccctgctaggacctgcagcagggcaagcccctccctgtgcctccctcaaacccctctcaggagctcctttggctgactacaggggttcaagttcacttgagggccagtgagtggctgctcagacagagcccatcactttaagtggtctcaaaggtgagctcttccttgagcatcacagaaagatttgtcacagccctgctggcgggaccgacgcctggaagaggtgttcccggactcttagggtcattctggtgaagctgaggctgggagttgggacttcccagggagggcctgtgggctgaggggcaagtagcacccagcggcccccacatcccagggagggagaaggtggcaaccattttggactcttctttttttgttaaattttatttcattcttctcatgtgggaaggtgatattaatcttttataggaaaggtagttttcttacatttttagcataacagatccccccctttataatagactatttttaaatagatttttttaagagcagttttaggtttccatagagccctgtccccatgtgcacacagcctcccctgtcgtcagcacctgcctcgagtggtgtgtttattatggtcgatgaaccgtggatatctcattactacacagagcccatcatttacatcaggggtccctcttggtggtgcacgttctgtgggctgggacaggtgtagactctgcagtcataaaccattccccaccacacagggcccttagttgtgacagtggaccaccggtgcgctcagtgacagcatgaccatttattatcattgggtttttaatacaggtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagaggaaaacagagaagcgggctctgggcagccacagaaaagctggctttccggagcaccctgtggcaccggaaccactcagtaacagctgccagatttccaaggagggcagaaagcagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgtta

SEQ ID NO: 354867 - DNA, 2875 bp, Homo sapiens
cgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagtattgagcaagtcaacaacctacgagagatccaagcactgaggcgcctgaatccgcacccaaacattcttatgttgcatgaagtggtttttgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtaagtattgtgttctgagagtggatgtggacccactcccctgctaggacctgcagcagggcaagcccctccctgtgcctccctcaaacccctctcaggagctcctttggctgactacaggggttcaagttcacttgagggccagtgagtggctgctcagacagagcccatcactttaagtggtctcaaaggtgagctcttccttgagcatcacagaaagatttgtcacagccctgctggcgggaccgacgcctggaagaggtgttcccggactcttagggtcattctggtgaagctgaggctgggagttgggacttcccagggagggcctgtgggctgaggggcaagtagcacccagcggcccccacatcccagggagggagaaggtggcaaccattttggactcttctttttttgttaaattttatttcattcttctcatgtgggaaggtgatattaatcttttataggaaaggtagttttcttacatttttagcataacagatccccccctttataatagactatttttaaatagatttttttaagagcagttttaggtttccatagagccctgtccccatgtgcacacagcctcccctgtcgtcagcacctgcctcgagtggtgtgtttattatggtcgatgaaccgtggatatctcattactacacagagcccatcatttacatcaggggtccctcttggtggtgcacgttctgtgggctgggacaggtgtagactctgcagtcataaaccattccccaccacacagggcccttagttgtgacagtggaccaccggtgcgctcagtgacagcatgaccatttattatcattgggtttttaatacaggtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagaggaaaacagagaagcgggctctgggcagccacagaaaagctggctttccggagcaccctgtggcaccggaaccactcagtaacagctgccagatttccaaggagggcagaaagcagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaaggtagcgcggaaccagcttctctgacggcgctgctcttcgacccagcccaggccgccactgaattttgtgtctgtaatttttctttgacagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgtta

SEQ ID NO: 354868 - DNA, 1897 bp, Homo sapiens
cgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagtattgagcaagtcaacaacctacgagagatccaagcactgaggcgcctgaatccgcacccaaacattcttatgttgcatgaagtggtttttgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacaggatcaggaatacctctactaacaaccaatttgtccccacaatgcctctccctcctgcacgcaatggtggcctatgatcccgatgagagaatcgccgcccaccaggccctgcagcacccctacttccaagaacagaggaaaacagagaagcgggctctgggcagccacagaaaagctggctttccggagcaccctgtggcaccggaaccactcagtaacagctgccagatttccaaggagggcagaaagcagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgtta

SEQ ID NO: 354869 - DNA, 2046 bp, Homo sapiens
cgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagtattgagcaagtcaacaacctacgagagatccaagcactgaggcgcctgaatccgcacccaaacattcttatgttgcatgaagtggtttttgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacaggtatgctctcggagatttgacagctctgaaattaataaaatgtgttaacattcagattcaagaatttgaataaatgaagtgtaattctatttttcctttatactgaatgcagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagaggaaaacagagaagcgggctctgggcagccacagaaaagctggctttccggagcaccctgtggcaccggaaccactcagtaacagctgccagatttccaaggagggcagaaagcagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgtta

SEQ ID NO: 354870 - DNA, 1687 bp, Homo sapiens
cgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagggagaagatacccattatcagaaaaaaaaattatgcactatatgtaccagttatgtaagtccctggatcatattcacagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacaggatcaggaatacctctactaacaaccaatttgtccccacaatgcctctccctcctgcacgcaatggtggcctatgatcccgatgagagaatcgccgcccaccaggccctgcagcacccctacttccaagaacagaggaaaacagagaagcgggctctgggcagccacagaaaagctggctttccggagcaccctgtggcaccggaaccactcagtaacagctgccagatttccaaggagggcagaaagcagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgtta

SEQ ID NO: 354871 - DNA, 2344 bp, Homo sapiens
cgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagtgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaaggtagcgcggaaccagcttctctgacggcgctgctcttcgacccagcccaggccgccactgaattttgtgtctgtaatttttctttgacagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgttaacaaaaaaaaaaaaaaaaaaaaaaaaaaaaacaaacaaaaaaaagacaaaaaaacaaacaacaaaaaaaaacacaaaaacaagggggggggcccacaaaacaacacccgagagggacaaaaaaaccacacaccaacacttgagacaaaaagggccacaaaagaagaccacatataaaaacaacacgcgcacgagataaacaaggagacgaggaacaaccagacacacgaaacaactaggaaaacacacaaaaacggagggcaccaacaccgagaaaaacacaacgcagataaccccacaagaacacaaaacaacaagagcaaaagcgacaccacagcaaacacccgcagcaaagaagtgagcacacagactagatcacagaaaaattacaagcgaggacagaaaacacccaccgaccaactgcaccacacgcaaagaacacgccagcaacgcccgactagcacagaagaactaaaaaagaaccaatacaaaaacaaccggaactcacaagaagagcacagacaac

SEQ ID NO: 354872 - DNA, 1722 bp, Homo sapiens
cgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagtgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaaggtagcgcggaaccagcttctctgacggcgctgctcttcgacccagcccaggccgccactgaattttgtgtctgtaatttttctttgacagacagatccgcagaaggaccttaagcctgccccgcagcagtgtcgcctgcccaccatagtgcggaaaggcggaagataactgagcagcaccgtcgtctcgacttcggaggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgtta

SEQ ID NO: 354873 - DNA, 1744 bp, Homo sapiens
cgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattggcaaaataggagagggaacgttttctgaagttatgaagatgcaaagcctgagagatggaaactactatgcatgtaaacaaatgaagcagcgctttgaaagtgacagaaaatctggttctcttgcactaatatgtgaacttatggacatgaatatttatgagctaatacgagggagaagatacccattatcagaaaaaaaaattatgcactatatgtaccagttatgtaagtccctggatcatattcacagaaatggaatatttcacagagatgtaaaaccagaaaatatactaataaagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccagtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaaggtagcgcggaaccagcttctctgacggcgctgctcttcgacccagcccaggccgccactgaattttgtgtctgtaatttttctttgacagacagatccgcagaaggaccttaagcctgccccgcagcagtgtcgcctgcccaccatagtgcggaaaggcggaagataactgagcagcaccgtcgtctcgacttcggaggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgttatacagtattgcaaaaaaatgtt

SEQ ID NO: 354874 - DNA, 349 bp, Homo sapiens
cgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagaactataaagcaattcatcaatttccactcctgcatttcccaaatcaattactgtcttcttcaaagagattgaaggtatattccatgccaccaccagcgaagtgtcatggatatcct

SEQ ID NO: 354875 - DNA, 2116 bp, Homo sapiens
attcctgagtctgtgactggtgctggagttttgagtccacagataaaatgtgtctccttcgtctctactagagaggaaaaagaactggaattggaagaacagggagactgaagggtagcaagagaggctggagaagagagtgaaaagaccgcttacctgatttgaaattgtctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagagaacccagaacggaagcgaggatgaggcctcagccgtcctcctccccattcaaacacgttcatccctcaaccctctgctgagcacctgcatgctgcccggccgcagtgtcacccttcttgtgtgagcctaccctcatccacccacctcaccctcctgaccttaaagaagacaccgggcagaagcacaggggagcccagtcacaccccacactggcgggggcaggccttgcagggagaagcagtaagcagccatctccatcagccatttccatctggcactcagacgtgcacgtcttcgtgtgacaggcggcagcagtgcgaccgtgacctcccatctgctctgctgtccccacacctgcggtgcagccagcctgccacaaggcagctagagtccagctagacccacccctggcacggccgacctcttcctggcttcttctgggcctaatccccgtgcattctccaacgccagaagtgtaagaaagtgcaaggcaacaagtgagaagagcaaacccaaatcgtaccagggaagctagtctttccagggcacctgagtgagggcatgaccagccttgacgctgcctcgctaccatctgcccagggcctgctgaatgcttgagtccatggtgacagtggtgggaacagttacgaggcagttagattttggaagtcatgttggcccacttggctacagagcagtcttaggaacagcaccataaaaataaagacttattcctgacacacatgcatctagagtaaactggggcgtatctgacagcgttagtacagtgatggccaaatgcaaactgcattccagaaccagcgaagggtgacagactgggctgaggcagagctaggactaaccatctcgagtgatgccatctcggggccaacaaaagttttggacacggctggatcatctgaccaaactgctcaaatctttacacaattattgtcctggtattaaactttcacctgccacttccaacaaacaggagacagaataaggagatgaccaggaagatggctggattaagaattctagacttggccgggtgcggtggctcacacctgtaatcctagcatcttgggaggctgaggcaggaggatcgcttgagcccaggagtttgagaccagcctaggcaacataaggagaccccatctctacaaaatatcaaaaaattacccaggtatggtggcacacacgtgtgattccagctactcgggaggctgagatgggaggatcacttgaacccaggaggttggggctacaatgagctatgatcgcaccacttcattccagcctggatgacagaagactcactccatagttcatggccccgtgatccagagtccctgctggcgccttcgagtggggcaggctgagaactcaagctgtaactaatgtctcctccgaagaaaactaaaccgagggctgagctgatgtgaagttttccgtggctgcattcatacaaatggtgaaaatgtagcatacctcccctcaaaagcctgaaagtaaagacatgcccccaatttaatgtgatgaattagagaaataggtttcagacacttcatggtttaaagtctcacaaaataaagctttcgaaggatccagttgtatatgattttttaaaaaaataaataaacattcttctgcttggtagctgcaca

SEQ ID NO: 354876 - DNA, 1220 bp, Homo sapiens
attcctgagtctgtgactggtgctggagttttgagtccacagataaaatgtgtctccttcgtctctactagagaggaaaaagaactggaattggaagaacagggagactgaagggtagcaagagaggctggagaagagagtgaaaagaccgcttacctgatttgaaattgatggtggcgtgggaatgaagaatgtgatatacatctttggagtctgttctgcagcccctctttcctggagtaaatgaactggaccaaatctcaaaaatccacgatgtcatcggcacacccgctcagaagatcctcaccaagttcaaacagtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgtta

SEQ ID NO: 354877 - DNA, 221 bp, Homo sapiens
ggaaagagaaaacagtggttaattgctgtcagaattgaattttgcaaaaccctgaataccatgaaatgtctgtgaatgtgtatatcctttttcacagtcacacacacatcatcataataacttttgagatggtaaataaaatgtatgtacccaaagcttaacaaattcaaatcatatgtgttaagctttgggtacatacattttatttaccatcttgtcga

SEQ ID NO: 354878 - DNA, 2229 bp, Homo sapiens
gagcagagccaacgtgtcagcggcgcccaagcggccccagcgggctcgcgtcgccccgctctcctcaccgagccgccaatcggctcaggatccgcccctgacgacgcgggccccgcccctggagacacgcgccgcgcagtcgtcacccgcccgggatcaggaggccgggggcgcccgccggtcgggcctgggcggccgccatgaagctgacgcggaagatggttctgacccgggccaaggcctcggagctgcacagcgtgcgcaagctcaactgctggggcagccgcctcacagatatctccatttgccaggagatgcccagcctggaggtgatcacgctcagtgtcaacagcatctccaccctggagcctgtgagccggtgccagcgcctgagtgagctgtacctgcggaggaaccgcatccccagcctggctgagctcttctacctgaaggggctgccgcgtctgcgggtgctgtggctggccgagaacccgtgctgcggcaccagcccccaccgctaccgcatgaccgtgctgcgcaccctgccgcgcctacagaagctggacaaccaggctgtgacggaggaggagctgtcccgtgcactgagtgagggagaggagatcactgcggccccagagagagagggcacaggccacggcggccccaagctatgctgcacactgagctccctcagctccgctgctgagactggccgggacccgctggacagcgaggaggaggcaaccagcggcgcccaggatgaacgtggcctgaagccgccttcccggggccagtttccttccctctcagccagggatgcctcgagcagccacaggggcaggaacgtcctgactgccatcctgctgctgctgcgggagctggatgcagaggggctggaggccgtgcagcagactgtgggcagccggctgcaggccctgcgtggggaagaggtgcaggagcacgccgagtgaccgcaggacctgaacgccgctccagcctccacggggaccccagcgtcttccccagcccccgggagctggagggtggctgccatggccgcagccccggccccacacaaaagcctccccggtttgccacatcggccgagggcaggagtgggtgttaggtactggctaaccggggcggtggagatgcctgtctacaccagtcctgtccccaggactccccttctgtggtctggaggttctaggctggcctgggctcttaaagggaggattttgcaggctgtcctccctaataaaagattttcccaaggttgatctggaggtgacgtttcccaaggcatggttgtgacagtcttcctgaaagcaagggccgtttctccacagaatgaggaggtcttcacggatggctttgccgattccagcccttggtccttggatagatttctgttgggcaagggagacttcgagaatgctggcacccatagcgacatctgccctgagctgctcagcaggcaggcagcagcctcccgcacccatgggagagagttttgttttcttggccgggctgggcaggtgcgccttcctttctctctcctgtgaagaactgcaggagggccctcagctgtgaggttgtggatgaacaggcctgttcgccctggggtccgggcctggcacaggaagcagctagactaggggagtccttggagcatctgagaggggttttctttcctctgggaagagtcgcaagtcttatgaggatgccacaatctgggcagtgacccgtggccctggggaccttcctagtgccccccaaaaccaaggaagcattcacgtgagatggggagtcagccttccagctggtgtgtaggaaagccaggtccctgggcccttgtcccatgtggggttgagatccagatctccatgagatattcccatcctccgccgagcggtgatgcgtgaccgtgtgtgcaggccgctgttctcccaagctcggggccatgccgtgccaccgtcaccagagccagctgcagcactggggcagccactgtcgccggacttggggaagcccagggtgaagacagtcactcatccgtgcaagctctccagaaggaagggatgcaagctctccagaaggggtgtgatctctgagcagtggggagtggagtcaccactcgggacatagagggtggacagttcaggcctgtgtctgcctccttgggactgtggagtgggtgccctcagtaaagcgctttgttggaatggt

SEQ ID NO: 354879 - DNA, 205 bp, Homo sapiens
  misc_feature (9)..(9): n is a, c, g, or t
gcgggccgncttactaactacctaattaccgggctggcgagaaagacgacagaagggatgcaagctctccagaaggggtgtgatctctgagcagtggggagtggagtcaccactcgggacatagagggtggacagttcaggcctgtgtctgcctccttgggactgtggagtgggtgccctcagtaaagcgctttgttggaatggt

SEQ ID NO: 354880 - DNA, 195 bp, Homo sapiens
gcggccgcctactactactatacggtttcgagaagacgacagaagggatgcaagctctccagaaggggtgtgatctctgagcagtggggagtggagtcaccactcgggacatagagggtggacagttcaggcctgtgtctgcctccttgggactgtggagtgggtgccctcagtaaagcgctttgttggaatggt

SEQ ID NO: 354881 - DNA, 890 bp, Homo sapiens
ttaatttgaactgtaccttttcttaaagacaaaaaaaagcctggatacgtggcatctgggtgtaatctgttttgtgctgtaactgaaatactgcatgtttagcagtgaatatacaaacgtaccatgtccatagacacgagtcacttatacatgggacgcatctgaccaggctgtgagctgctggtgccatgcctggcgtatggtgggctctcacatatgtgggagctttgcaggttgtgaggctttgtggaccaccccgggcacctcacccctgaattgacagtaccaatgtgatctgagatccagtctcaagcctgtcttccttttggcctagacctgttatcaagaagggatttccatcctttccttgctttctatccctgcgtaggggacattggggtccccttacctgatgtcctttgagggcatctaaagtaatgaatgctctgtctccactgctggcagcatctgacagcaacgatgctgtcgtaaaatttaataaagacagagtgcgtgcaaggaggagcctcacatttctccttcagtctgcggggcgtctgggctgcaaggtggtgtcagaggagaacctggcatactcgtgggcattcatcctgggcacactggctgagcagggccgctcccctcaggccctgggcattcaccctgggcacactggctgagcagggccgctcccctcaggccctgggcattcaccctgggcacactggctgagcagggccgctcccctcaggccctgggcattcaccctgggcacactggctgagtaaggccgtgcccctcaggccccggaagtgggttggccgtggcttcgacagttctctgtggctgatggcagtgcggccgcgatgccctgctgtgccatgcttgct

SEQ ID NO: 354882 - DNA, 776 bp, Homo sapiens
acatacagtttagttgaaaatcagctaaaacaattgtttacacctttgccagttatctgggcaaccttccttttttgccatgccattaaaatcctagaatcttaaggtttgtagggagtcatcggtgatttttggaatttttgtcttcagtgttttttattcaactttaacaaaattaaagtatgtatcttttctctccccaggggcagccgcctcacagatgtaagtattgcctcacagatgtaagtattgcactgatcatctccaaatagcctcaacccaaatgttgtagcttctttcccaagagaatttttaagttgacaaaactgcacctatcaattcagtcccacacttggtactttgttcacttagcggttttcattctgcagaaccactaatggaaaaacaattctctagtgccaggcttattttgcagttcccgtcaacatccctataaatgaaacaccctttgtcacttggtcgcagaggaggggagcaatagtttggaacttgctctcacctggaaaggaatcccaggagggcttgttttactttgttacggggaagttgaaggtctacaccccctcttcttggtcacatctagccttgtacccccttgccgctgccccaaaggcaggcagagaataagccctgctgggagaacttgagtgtgtgcgtctgtgaaagatttttttcttctctccctcattgtctttctcagtccaaaatgtccccaacttacacagggatcgcataccaattgtttctttcttttt

SEQ ID NO: 354883 - DNA, 691 bp, Homo sapiens
  misc_feature (27)..(27): n is a, c, g, or t
tatcaattcgggcaggaggaggacggncggacggacggacggggcgtctgggctgcaaggtggtgtcagaggggaacctggcatactcgtgggcatctaaagtaatgaatgctctgtctccactgctggcagcatctgacagcaacgatgctgtcgtaaaatttaataaagacagagtgcgtgcaaggaggagcctcacatttctccttcagtctgcggggcgtctgggctgcaaggtggtgtcagaggagaacctggcatactcgtgggcattcatcctgggcacactggctgagcagggccgctcccctcagggtggccacatctgccctgggacccccagagtcctggcctcttctgccccccagtgccaccactgcctaccagtttctctgcaccccatgacctgtgcccgtcttctggggtcactgccctcccagcagactaagggaagcttgaatgaacaaatgttactggactttcaggcagttggggtgtatttgggggctctggggaagagaagagctccctttatccctgaattccctcctgcctactgtgggacccacggagggagcagacgctcatggctcaccactgcccaccagacgctggatgggcgccttctgtgggtttccgcatttaaaagctcacaagggtttaaaccctgtggggaaggcccacccctctg

SEQ ID NO: 354884 - DNA, 2043 bp, Homo sapiens
gagcagagccaacgtgtcagcggcgcccaagcggccccagcgggctcgcgtcgccccgctctcctcaccgagccgccaatcggctcaggatccgcccctgacgacgcgggccccgcccctggagacacgcgccgcgcagtcgtcacccgcccgggatcaggaggccgggggcgcccgccggtcgggcctgggcggccgccatgaagctgacgcggaagatggttctgacccgggccaaggcctcggagctgcacagcgtgcgcaagctcaactgctggggcagccgcctcacagatatctccatttgccaggagatgcccagcctggaggtgatcacgctcagtgtcaacagcatctccaccctggagcctgtgagccggtgccagcgcctgagtgagctgtacctgcggaggaaccgcatccccagcctggctgagctcttctacctgaaggggctgccgcgtctgcgggtgctgtggctggccgagaacccgtgctgcggcaccagcccccaccgctaccgcatgaccgtgctgcgcaccctgccgcgcctacagaagctggacaaccaggctgtgacggaggaggagctgtcccgtgcactgagtgagggagaggagatcactgcggccccagagagagagggcacaggccacggcggccccaagctatgctgcacactgagctccctcagctccgctgctgagactggccgggacccgctggacagcgaggaggaggcaaccagcggcgcccaggatgaacgtggcctgaagccgccttcccggggccagtttccttccctctcagccagggatgcctcgagcagccacaggggcaggaacgtcctgactgccatcctgctgctgctgcgggagctggatgcagaggggctggaggccgtgcagcagactgtgggcagccggctgcaggccctgcgtggggaagaggtgcaggagcacgccgagtgaccgcaggacctgaacgccgctccagcctccacggggaccccagcgtcttccccagcccccgggagctggagggtggctgccatggccgcagccccggccccacacaaaagcctccccggtttgccacatcggccgagggcaggagtgggtgttaggtactggctaaccggggcggtggagatgcctgtctacaccagtcctgtccccaggactccccttctgtggtctggaggttctaggctggcctgggctcttaaagggaggattttgcaggctgtcctccctaataaaagattttcccaaggttgatctggaggtgacgtttcccaaggcatggttgtgacagtcttcctgaaagcaagggccgtttctccacagaatgaggaggtcttcacggatggctttgccgattccagcccttggtccttggatagatttctgttgggcaagggagacttcgagaatgctggcacccatagcgacatctgccctgagctgctcagcaggcaggcagcagcctcccgcacccatgggagagagttttgttttcttggccgggctgggcaggtgcgccttcctttctctctcctgtgaagaactgcaggagggccctcagctgtgaggttgtggatgaacaggcctgttcgccctggggtccgggcctggcacaggaagcagctagactaggggagtccttggagcatctgagaggggttttctttcctctgggaagagtcgcaagtcttatgaggatgccacaatctgggcagtgacccgtggccctggggaccttcctagtgccccccaaaaccaaggaagcattcacgtgagatggggagtcagccttccagctggtgtgtaggaaagccaggtccctgggcccttgtcccatgtggggttgagatccagatctccatgaaagggatgcaagctctccagaaggggtgtgatctctgagcagtggggagtggagtcaccactcgggacatagagggtggacagttcaggcctgtgtctgcctccttgggactgtggagtgggtgccctcagtaaagcgctttgttggaatggt

SEQ ID NO: 354885 - DNA, 1642 bp, Homo sapiens
gagcagagccaacgtgtcagcggcgcccaagcggccccagcgggctcgcgtcgccccgctctcctcaccgagccgccaatcggctcaggatccgcccctgacgacgcgggccccgcccctggagacacgcgccgcgcagtcgtcacccgcccgggatcaggaggccgggggcgcccgccggtcgggcctgggcggccgccatgaagctgacgcggaagatggttctgacccgggccaaggcctcggagctgcacagcgtgcgcaagctcaactgctggggcagccgcctcacagatatctccatttgccaggagatgcccagcctggaggtgatcacgctcagtgtcaacagcatctccaccctggagcctgtgagccggtgccagcgcctgagtgagctgtacctgcggaggaaccgcatccccagcctggctgagctcttctacctgaaggggctgccgcgtctgcgggtgctgtggctggccgagaacccgtgctgcggcaccagcccccaccgctaccgcatgaccgtgctgcgcaccctgccgcgcctacagaagctggacaaccaggctgtgacggaggaggagctgtcccgtgcactgagtgagggagaggagatcactgcggccccagagagagagggcacaggccacggcggccccaagctatgctgcacactgagctccctcagctccgctgctgagactggccgggacccgctggacagcgaggaggaggcaaccagcggcgcccaggatgaacgtggcctgaagccgccttcccggggccagtttccttccctctcagccagggatgcctcgagcagccacaggggcaggaacgtcctgactgccatcctgctgctgctgcgggagctggatgcagaggggctggaggccgtgcagcagactgtgggcagccggctgcaggccctgcgtggggaagaggtgcaggagcacgccgagtgaccgcaggacctgaacgccgctccagcctccacggggaccccagcgtcttccccagcccccgggagctggagggtggctgccatggccgcagccccggccccacacaaaagcctccccggtttgccacatcggccgagggcaggagtgggtgttaggtactggctaaccggggcggtggagatgcctgtctacaccagtcctgtccccaggactccccttctgtggtctggaggttctaggctggcctgggctcttaaagggaggattttgcaggctgtcctccctaataaaagattttcccaaggttgatctggaggtgacgtttcccaaggcatggttgtgacagtcttcctgaaagcaagggccgtttctccacagaatgaggaggtcttcacggatggctttgccgattccagcccttggtccttggatagatttctgttgggcaagggagacttcgagaatgctggcacccatagcgacatctgccctgagctgctcagcaggcaggcagcagcaagggatgcaagctctccagaaggggtgtgatctctgagcagtggggagtggagtcaccactcgggacatagagggtggacagttcaggcctgtgtctgcctccttgggactgtggagtgggtgccctcagtaaagcgctttgttggaatggt

SEQ ID NO: 354886 - DNA, 2152 bp, Homo sapiens
  misc_feature (66)..(67): n is a, c, g, or t
  misc_feature (107)..(107): n is a, c, g, or t
  misc_feature (112)..(112): n is a, c, g, or t
  misc_feature (114)..(114): n is a, c, g, or t
  misc_feature (117)..(117): n is a, c, g, or t
  misc_feature (119)..(119): n is a, c, g, or t
  misc_feature (121)..(121): n is a, c, g, or t
tcagcagagtgaccgcgccgtgtcaactggcctcaccgtgcaggcgggtgtgggggtcagcgagannagacgcttcctcccaggggtgtccgcagactgcccagagngagcncntcncngnttagagatggagtttcactgtgtcggccaggctggtctcaaaccccctgagttcaggtgatccacctgcctcagcctcgcaaagtattggaattacagatctccatttgccaggagatgcccagcctggaggtgatcacgctcagtgtcaacagcatctccaccctggagcctgtgagccggtgccagcgcctgagtgagctgtacctgcggaggaaccgcatccccagcctggctgagctcttctacctgaaggggctgccgcgtctgcgggtgctgtggctggccgagaacccgtgctgcggcaccagcccccaccgctaccgcatgaccgtgctgcgcaccctgccgcgcctacagaagctggacaaccaggctgtgacggaggaggagctgtcccgtgcactgagtgagggagaggagatcactgcggccccagagagagagggcacaggccacggcggccccaagctatgctgcacactgagctccctcagctccgctgctgagactggccgggacccgctggacagcgaggaggaggcaaccagcggcgcccaggatgaacgtggcctgaagccgccttcccggggccagtttccttccctctcagccagggatgcctcgagcagccacaggggcaggaacgtcctgactgccatcctgctgctgctgcgggagctggatgcagaggggctggaggccgtgcagcagactgtgggcagccggctgcaggccctgcgtggggaagaggtgcaggagcacgccgagtgaccgcaggacctgaacgccgctccagcctccacggggaccccagcgtcttccccagcccccgggagctggagggtggctgccatggccgcagccccggccccacacaaaagcctccccggtttgccacatcggccgagggcaggagtgggtgttaggtactggctaaccggggcggtggagatgcctgtctacaccagtcctgtccccaggactccccttctgtggtctggaggttctaggctggcctgggctcttaaagggaggattttgcaggctgtcctccctaataaaagattttcccaaggttgatctggaggtgacgtttcccaaggcatggttgtgacagtcttcctgaaagcaagggccgtttctccacagaatgaggaggtcttcacggatggctttgccgattccagcccttggtccttggatagatttctgttgggcaagggagacttcgagaatgctggcacccatagcgacatctgccctgagctgctcagcaggcaggcagcagcctcccgcacccatgggagagagttttgttttcttggccgggctgggcaggtgcgccttcctttctctctcctgtgaagaactgcaggagggccctcagctgtgaggttgtggatgaacaggcctgttcgccctggggtccgggcctggcacaggaagcagctagactaggggagtccttggagcatctgagaggggttttctttcctctgggaagagtcgcaagtcttatgaggatgccacaatctgggcagtgacccgtggccctggggaccttcctagtgccccccaaaaccaaggaagcattcacgtgagatggggagtcagccttccagctggtgtgtaggaaagccaggtccctgggcccttgtcccatgtggggttgagatccagatctccatgagatattcccatcctccgccgagcggtgatgcgtgaccgtgtgtgcaggccgctgttctcccaagctcggggccatgccgtgccaccgtcaccagagccagctgcagcactggggcagccactgtcgccggacttggggaagcccagggtgaagacagtcactcatccgtgcaagctctccagaaggaagggatgcaagctctccagaaggggtgtgatctctgagcagtggggagtggagtcaccactcgggacatagagggtggacagttcaggcctgtgtctgcctccttgggactgtggagtgggtgccctcagtaaagcgctttgttggaatggt

SEQ ID NO: 354887 - DNA, 2836 bp, Homo sapiens
gagcagagccaacgtgtcagcggcgcccaagcggccccagcgggctcgcgtcgccccgctctcctcaccgagccgccaatcggctcaggatccgcccctgacgacgcgggccccgcccctggagacacgcgccgcgcagtcgtcacccgcccgggatcaggaggccgggggcgcccgccggtcgggcctgggcggccgccatgaagctgacgcggaagatggttctgacccgggccaaggcctcggagctgcacagcgtgcgcaagctcaactgctggggcagccgcctcacagatatctccatttgccaggagatgcccagcctggaggtgatcacgctcagtgtcaacagcatctccaccctggagcctgtgagccggtgccagcgcctgagtgagctgtacctgcggaggaaccgcatccccagcctggctgagctcttctacctgaaggggctgccgcgtctgcgggtgctgtggctggccgagaacccgtgctgcggcaccagcccccaccgctaccgcatgaccgtgctgcgcaccctgccgcgcctacagaagctggacaaccaggatgtgtcctgtgaagtctcctccagaggctgttcccctggcttctgtgtctcctcttgatcccgccacccgaatgcagcagcgcagcgtagggtccctcctgggactgacacgccagcaccgacacagttttccaggctgtggtttcatgctgtttgttcatccttggcattctcagcacactagtgtctcatccttgtcaggtatacagacaccactattttctcccagacaattttattgatattaataatataaacttcagggaaattgatatatgagagaaatggaataaattcaatatggtctgttcctttttctattgtgtcgtagttgaggttttgaggagtatttgcttctggccaaggctggtgttgagattcctgagcagccctccaccatctgttgtgtgtcagcctgtgccaggctggggatgggacagtgaggaaccggctgctactctgggagttgtccctggaggtggatacacgtgcatgcatttcacaagcagactgtgcctgaagccacagtgaggacgggagctgcagtgcatgtggcctgcacgtgggtgaggccactcatgctgtcttctgtctttcatcccaaagctgtgacggaggaggagctgtcccgtgcactgagtgagggagaggagatcactgcggccccagagagagagggcacaggccacggcggccccaagctatgctgcacactgagctccctcagctccgctgctgagactggccgggacccgctggacagcgaggaggaggcaaccagcggcgcccaggatgaacgtggcctgaagccgccttcccggggccagtttccttccctctcagccagggatgcctcgagcagccacaggggcaggaacgtcctgactgccatcctgctgctgctgcgggagctggatgcagaggggctggaggccgtgcagcagactgtgggcagccggctgcaggccctgcgtggggaagaggtgcaggagcacgccgagtgaccgcaggacctgaacgccgctccagcctccacggggaccccagcgtcttccccagcccccgggagctggagggtggctgccatggccgcagccccggccccacacaaaagcctccccggtttgccacatcggccgagggcaggagtgggtgttaggtactggctaaccggggcggtggagatgcctgtctacaccagtcctgtccccaggactccccttctgtggtctggaggttctaggctggcctgggctcttaaagggaggattttgcaggctgtcctccctaataaaagattttcccaaggttgatctggaggtgacgtttcccaaggcatggttgtgacagtcttcctgaaagcaagggccgtttctccacagaatgaggaggtcttcacggatggctttgccgattccagcccttggtccttggatagatttctgttgggcaagggagacttcgagaatgctggcacccatagcgacatctgccctgagctgctcagcaggcaggcagcagcctcccgcacccatgggagagagttttgttttcttggccgggctgggcaggtgcgccttcctttctctctcctgtgaagaactgcaggagggccctcagctgtgaggttgtggatgaacaggcctgttcgccctggggtccgggcctggcacaggaagcagctagactaggggagtccttggagcatctgagaggggttttctttcctctgggaagagtcgcaagtcttatgaggatgccacaatctgggcagtgacccgtggccctggggaccttcctagtgccccccaaaaccaaggaagcattcacgtgagatggggagtcagccttccagctggtgtgtaggaaagccaggtccctgggcccttgtcccatgtggggttgagatccagatctccatgagatattcccatcctccgccgagcggtgatgcgtgaccgtgtgtgcaggccgctgttctcccaagctcggggccatgccgtgccaccgtcaccagagccagctgcagcactggggcagccactgtcgccggacttggggaagcccagggtgaagacagtcactcatccgtgcaagctctccagaaggaagggatgcaagctctccagaaggggtgtgatctctgagcagtggggagtggagtcaccactcgggacatagagggtggacagttcaggcctgtgtctgcctccttgggactgtggagtgggtgccctcagtaaagcgctttgttggaatggt

SEQ ID NO: 354888 - DNA, 2770 bp, Homo sapiens
gagcagagccaacgtgtcagcggcgcccaagcggccccagcgggctcgcgtcgccccgctctcctcaccgagccgccaatcggctcaggatccgcccctgacgacgcgggccccgcccctggagacacgcgccgcgcagtcgtcacccgcccgggatcaggaggccgggggcgcccgccggtcgggcctgggcggccgccatgaagctgacgcggaagatggttctgacccgggccaaggcctcggagctgcacagcgtgcgcaagctcaactgctgtgtcaacagcatctccaccctggagcctgtgagccggtgccagcgcctgagtgagctgtacctgcggaggaaccgcatccccagcctggctgagctcttctacctgaaggggctgccgcgtctgcgggtgctgtggctggccgagaacccgtgctgcggcaccagcccccaccgctaccgcatgaccgtgctgcgcaccctgccgcgcctacagaagctggacaaccaggatgtgtcctgtgaagtctcctccagaggctgttcccctggcttctgtgtctcctcttgatcccgccacccgaatgcagcagcgcagcgtagggtccctcctgggactgacacgccagcaccgacacagttttccaggctgtggtttcatgctgtttgttcatccttggcattctcagcacactagtgtctcatccttgtcaggtatacagacaccactattttctcccagacaattttattgatattaataatataaacttcagggaaattgatatatgagagaaatggaataaattcaatatggtctgttcctttttctattgtgtcgtagttgaggttttgaggagtatttgcttctggccaaggctggtgttgagattcctgagcagccctccaccatctgttgtgtgtcagcctgtgccaggctggggatgggacagtgaggaaccggctgctactctgggagttgtccctggaggtggatacacgtgcatgcatttcacaagcagactgtgcctgaagccacagtgaggacgggagctgcagtgcatgtggcctgcacgtgggtgaggccactcatgctgtcttctgtctttcatcccaaagctgtgacggaggaggagctgtcccgtgcactgagtgagggagaggagatcactgcggccccagagagagagggcacaggccacggcggccccaagctatgctgcacactgagctccctcagctccgctgctgagactggccgggacccgctggacagcgaggaggaggcaaccagcggcgcccaggatgaacgtggcctgaagccgccttcccggggccagtttccttccctctcagccagggatgcctcgagcagccacaggggcaggaacgtcctgactgccatcctgctgctgctgcgggagctggatgcagaggggctggaggccgtgcagcagactgtgggcagccggctgcaggccctgcgtggggaagaggtgcaggagcacgccgagtgaccgcaggacctgaacgccgctccagcctccacggggaccccagcgtcttccccagcccccgggagctggagggtggctgccatggccgcagccccggccccacacaaaagcctccccggtttgccacatcggccgagggcaggagtgggtgttaggtactggctaaccggggcggtggagatgcctgtctacaccagtcctgtccccaggactccccttctgtggtctggaggttctaggctggcctgggctcttaaagggaggattttgcaggctgtcctccctaataaaagattttcccaaggttgatctggaggtgacgtttcccaaggcatggttgtgacagtcttcctgaaagcaagggccgtttctccacagaatgaggaggtcttcacggatggctttgccgattccagcccttggtccttggatagatttctgttgggcaagggagacttcgagaatgctggcacccatagcgacatctgccctgagctgctcagcaggcaggcagcagcctcccgcacccatgggagagagttttgttttcttggccgggctgggcaggtgcgccttcctttctctctcctgtgaagaactgcaggagggccctcagctgtgaggttgtggatgaacaggcctgttcgccctggggtccgggcctggcacaggaagcagctagactaggggagtccttggagcatctgagaggggttttctttcctctgggaagagtcgcaagtcttatgaggatgccacaatctgggcagtgacccgtggccctggggaccttcctagtgccccccaaaaccaaggaagcattcacgtgagatggggagtcagccttccagctggtgtgtaggaaagccaggtccctgggcccttgtcccatgtggggttgagatccagatctccatgagatattcccatcctccgccgagcggtgatgcgtgaccgtgtgtgcaggccgctgttctcccaagctcggggccatgccgtgccaccgtcaccagagccagctgcagcactggggcagccactgtcgccggacttggggaagcccagggtgaagacagtcactcatccgtgcaagctctccagaaggaagggatgcaagctctccagaaggggtgtgatctctgagcagtggggagtggagtcaccactcgggacatagagggtggacagttcaggcctgtgtctgcctccttgggactgtggagtgggtgccctcagtaaagcgctttgttggaatggt

SEQ ID NO: 354889 - DNA, 2097 bp, Homo sapiens
tttgagttcagggcctggccttcctacagctctctcctcggcccaggtcctgctgcacgtgacttgtgacatccgatttaggcttctcaggagagggcagggacacaggtcccatgagtgccttttactgggggtggggattgagaggtggccctgggggccctggccacgtccctcgctgactgtgctggtctccgtgcagtgtcaacagtgtcaacagcatctccaccctggagcctgtgagccggtgccagcgcctgagtgagctgtacctgcggaggaaccgcatccccagcctggctgagctcttctacctgaaggggctgccgcgtctgcgggtgctgtggctggccgagaacccgtgctgcggcaccagcccccaccgctaccgcatgaccgtgctgcgcaccctgccgcgcctacagaagctggacaaccaggctgtgacggaggaggagctgtcccgtgcactgagtgagggagaggagatcactgcggccccagagagagagggcacaggccacggcggccccaagctatgctgcacactgagctccctcagctccgctgctgagactggccgggacccgctggacagcgaggaggaggcaaccagcggcgcccaggatgaacgtggcctgaagccgccttcccggggccagtttccttccctctcagccagggatgcctcgagcagccacaggggcaggaacgtcctgactgccatcctgctgctgctgcgggagctggatgcagaggggctggaggccgtgcagcagactgtgggcagccggctgcaggccctgcgtggggaagaggtgcaggagcacgccgagtgaccgcaggacctgaacgccgctccagcctccacggggaccccagcgtcttccccagcccccgggagctggagggtggctgccatggccgcagccccggccccacacaaaagcctccccggtttgccacatcggccgagggcaggagtgggtgttaggtactggctaaccggggcggtggagatgcctgtctacaccagtcctgtccccaggactccccttctgtggtctggaggttctaggctggcctgggctcttaaagggaggattttgcaggctgtcctccctaataaaagattttcccaaggttgatctggaggtgacgtttcccaaggcatggttgtgacagtcttcctgaaagcaagggccgtttctccacagaatgaggaggtcttcacggatggctttgccgattccagcccttggtccttggatagatttctgttgggcaagggagacttcgagaatgctggcacccatagcgacatctgccctgagctgctcagcaggcaggcagcagcctcccgcacccatgggagagagttttgttttcttggccgggctgggcaggtgcgccttcctttctctctcctgtgaagaactgcaggagggccctcagctgtgaggttgtggatgaacaggcctgttcgccctggggtccgggcctggcacaggaagcagctagactaggggagtccttggagcatctgagaggggttttctttcctctgggaagagtcgcaagtcttatgaggatgccacaatctgggcagtgacccgtggccctggggaccttcctagtgccccccaaaaccaaggaagcattcacgtgagatggggagtcagccttccagctggtgtgtaggaaagccaggtccctgggcccttgtcccatgtggggttgagatccagatctccatgagatattcccatcctccgccgagcggtgatgcgtgaccgtgtgtgcaggccgctgttctcccaagctcggggccatgccgtgccaccgtcaccagagccagctgcagcactggggcagccactgtcgccggacttggggaagcccagggtgaagacagtcactcatccgtgcaagctctccagaaggaagggatgcaagctctccagaaggggtgtgatctctgagcagtggggagtggagtcaccactcgggacatagagggtggacagttcaggcctgtgtctgcctccttgggactgtggagtgggtgccctcagtaaagcgctttgttggaatggt

SEQ ID NO: 354890 - DNA, 1366 bp, Homo sapiens
  misc_feature (1286)..(1286): n is a, c, g, or t
gagcagagccaacgtgtcagcggcgcccaagcggccccagcgggctcgcgtcgccccgctctcctcaccgagccgccaatcggctcaggatccgcccctgacgacgcgggccccgcccctggagacacgcgccgcgcagtcgtcacccgcccgggatcaggaggccgggggcgcccgccggtcgggcctgggcggccgccatgaagctgacgcggaagatggttctgacccgggccaaggcctcggagctgcacagcgtgcgcaagctcaactgctggggcagccgcctcacagatatctccatttgccaggagatgcccagcctggaggtgatcacgctcagtgtcaacagcatctccaccctggagcctgtgagccggtgccagcgcctgagtgagctgtacctgcggaggaaccgcatccccagcctggctgagctcttctacctgaaggggctgccgcgtctgcgggtgctgtggctggccgagaacccgtgctgcggcaccagcccccaccgctaccgcatgaccgtgctgcgcaccctgccgcgcctacagaagctggacaaccaggctgtgacggaggaggagctgtcccgtgcactgagtgagggagaggagatcactgcggccccagagagagagggcacaggccacggcggccccaagctatgctgcacactgagctccctcagctccgctgctgagactggccgggacccgctggacagcgaggaggaggcaaccagcggcgcccaggatgaacgtggcctgaagccgccttcccggggccagtttccttccctctcagccagggatgcctcgagcagccacaggggcaggaacgtcctgactgccatcctgctgctgctgcgggagctggatgcagaggggctggaggccgtgcagcagactgtgggcagccggctgcaggccctgcgtggggaagaggtgcaggagcacgccgagtgaccgcaggacctgaacgccgctccagcctccacggggaccccagcgtcttccccagcccccgggagctggagggtggctgccatggccgcagccccggccccacacaaaagcctccccggtttgccacatcggccgagggcaggagtgggtgttaggtactggctaaccggggcggtggagatgcctgtctacaccagtcctgtccccaggactccccttctgtggtctggaggttctaggctggcctgggctcttaaagggaggattttgcaggctgtcctccctaataaaagattttcccagcgtaaaaaccanaaaaaaactcgagcggggcccggaccaattcgcctaagtgagcggatacaatcactgcccgcgtttacacggtggactgg

SEQ ID NO: 354891 - DNA, 1037 bp, Homo sapiens
ccgggccctgctgggctgagggcaacaggagtcacgtggaagaggtgccacacacgcgtccacaggcggggctcctctgctcagattctccgagtgtgccggtcagtcacttggacggcccacacccccgggaccagtcgctccgtggtggggcaccgctggccaggccccagcccttgtggagggaagcagcctcgctgtgccgggtgggcttagtccgcacccctctgccctcagaacgtcctgactgccatcctgctgctgctgcgggagctggatgcagaggggctggaggccgtgcagcagactgtgggcagccggctgcaggccctgcgtggggaagaggtgcaggagcacgccgagtgaccgcaggacctgaacgccgctccagcctccacggggaccccagcgtcttccccagcccccgggagctggagggtggctgccatggccgcagccccggccccacacaaaagcctccccggtttgccacatcggccgagggcaggagtgggtgttaggtactggctaaccggggcggtggagatgcctgtctacaccagtcctgtccccaggactccccttctgtggtctggaggttctaggctggcctgggctcttaaagggaggattttgcaggctgtcctccctaataaaagattttcccaaggttgatctggaggtgacgtttcccaaggcatggttgtgacagtcttcctgaaagcaagggccgtttctccacagaatgaggaggtcttcacggatggctttgccgattccagcccttggtccttggatagatttctgttgggcaagggagacttcgagaatgctggcacccatagcgacatctgccctgagctgctcagcaggcaggcagcagcaagggatgcaagctctccagaaggggtgtgatctctgagcagtggggagtggagtcaccactcgggacatagagggtggacagttcaggcctgtgtctgcctccttgggactgtggagtgggtgccctcagtaaagcgctttgttggaatggt

SEQ ID NO: 354892 - DNA, 629 bp, Homo sapiens
cgcccttgggcgcacttctgagagaggttccacgggagatacaagatgagtggccatagggagtccttggagcatctgagaggggttttctttcctctgggaagagtcgcaagtcttatgaggatgccacaatctgggcagtgacccgtggccctggggaccttcctagtgccccccaaaaccaaggaagcattcacgtgagatggggagtcagccttccagctggtgtgtaggaaagccaggtccctgggcccttgtcccatgtggggttgagatccagatctccatgagatattcccatcctccgccgagcggtgatgcgtgaccgtgtgtgcaggccgctgttctcccaagctcggggccatgccgtgccaccgtcaccagagccagctgcagcactggggcagccactgtcgccggacttggggaagcccagggtgaagacagtcactcatccgtgcaagctctccagaaggaagggatgcaagctctccagaaggggtgtgatctctgagcagtggggagtggagtcaccactcgggacatagagggtggacagttcaggcctgtgtctgcctccttgggactgtggagtgggtgccctcagtaaagcgctttgttggaatggt

SEQ ID NO: 354893 - DNA, 947 bp, Homo sapiens
ttaatttgaactgtaccttttcttaaagacaaaaaaaagcctggatacgtggcatctgggtgtaatctgttttgtgctgtaactgaaatactgcatgtttagcagtgaatatacaaacgtaccatgtccatagacacgagtcacttatacatgggacgcatctgaccaggctgtgagctgctggtgccatgcctggcgtatggtgggctctcacatatgtgggagctttgcaggttgtgaggctttgtggaccaccccgggcacctcacccctgaattgacagtaccaatgtgatctgagatccagtctcaagcctgtcttccttttggcctagacctgttatcaagaagggatttccatcctttccttgctttctatccctgcgtaggggacattggggtccccttacctgatgtcctttgagggcatctaaagtaatgaatgctctgtctccactgctggcagcatctgacagcaacgatgctgtcgtaaaatttaataaagacagagtgcgtgcaaggaggagcctcacatttctccttcagtctgcggggcgtctgggctgcaaggtggtgtcagaggagaacctggcatactcgtgggcattcatcctgggcacactggctgagcagggccgctcccctcagctcaggccctgggcattcaccctgggcacactggctgagcagggccgctcccctcaggccctgggcattcaccctgggcacactggctgagcagggccgctcccctcaggccctgggcattcaccctgggcacactggctgagcagggccgctcccctcaggccctgggcattcaccctgggcacactggctgagtaaggccgtgcccctcaggccccggaagtgggttggccgtggcttcgacagttctctgtggctgatggcagtgcggccgcgatgccctgctgtgccatgcttgct

SEQ ID NO: 354894 - DNA, 850 bp, Homo sapiens
gagcagagccaacgtgtcagcggcgcccaagcggccccagcgggctcgcgtcgccccgctctcctcaccgagccgccaatcggctcaggatccgcccctgacgacgcgggccccgcccctggagacacgcgccgcgcagtcgtcacccgcccgggatcaggaggccgggggcgcccgccggtcgggcctgggcggccgccatgaagctgacgcggaagatggttctgacccgggccaaggcctcggagctgcacagcgtgcgcaagctcaactgctggggcagccgcctcacagatgtaagtattgcctcacagatgtaagtattgcactgatcatctccaaatagcctcaacccaaatgttgtagcttctttcccaagagaatttttaagttgacaaaactgcacctatcaattcagtcccacacttggtactttgttcacttagcggttttcattctgcagaaccactaatggaaaaacaattctctagtgccaggcttattttgcagttcccgtcaacatccctataaatgaaacaccctttgtcacttggtcgcagaggaggggagcaatagtttggaacttgctctcacctggaaaggaatcccaggagggcttgttttactttgttacggggaagttgaaggtctacaccccctcttcttggtcacatctagccttgtacccccttgccgctgccccaaaggcaggcagagaataagccctgctgggagaacttgagtgtgtgcgtctgtgaaagatttttttcttctctccctcattgtctttctcagtccaaaatgtccccaacttacacagggatcgcataccaattgtttctttcttttt

SEQ ID NO: 354895 - DNA, 1830 bp, Homo sapiens
gagcagagccaacgtgtcagcggcgcccaagcggccccagcgggctcgcgtcgccccgctctcctcaccgagccgccaatcggctcaggatccgcccctgacgacgcgggccccgcccctggagacacgcgccgcgcagtcgtcacccgcccgggatcaggaggccgggggcgcccgccggtcgggcctgggcggccgccatgaagctgacgcggaagatggttctgacccgggccaaggcctcggagctgcacagcgtgcgcaagctcaactgctggggcagccgcctcacagatatctccatttgccaggagatgcccagcctggaggtgatcacgctcagtgtcaacagcatctccaccctggagcctgtgagccggtgccagcgcctgagtgagctgtacctgcggaggaaccgcatccccagcctggctgagctcttctacctgaaggggctgccgcgtctgcgggtgctgtggctggccgagaacccgtgctgcggcaccagcccccaccgctaccgcatgaccgtgctgcgcaccctgccgcgcctacagaagctggacaaccaggctgtgacggaggaggagctgtcccgtgcactgagtgagggagaggagatcactgcggccccagagagagagggcacaggccacggcggccccaagctatgctgcacactgagctccctcagctccgctgctgagactggccgggacccgctggacagcgaggaggaggcaaccagcggcgcccaggatgaacgtggcctgaagccgccttcccggggccagtttccttccctctcagccagggatgcctcgagcagccacaggggcaggaacgtcctgactgccatcctgctgctgctgcgggagctggatgcagaggggctggaggccgtgcagcagactgtgggcagccggctgcaggccctgcgtggggaagaggtgcaggagcacgccgagtgaccgcaggacctgaacgccgctccagcctccacggggaccccagcgtcttccccagcccccgggagctggagggtggctgccatggccgcagccccggccccacacaaaagcctccccggtttgccacatcggccgagggcaggagtgggtgttaggtactggctaaccggggcggtggagatgcctgtctacaccagtcctgtccccaggactccccttctgtggtctggaggttctaggctggcctgggctcttaaagggaggattttgcaggctgtcctccctaataaaagattttcccaaggttgatctggaggtgacgtttcccaaggcatggttgtgacagtcttcctgaaagcaagggccgtttctccacagaatgaggaggtcttcacggatggctttgccgattccagcccttggtccttggatagatttctgttgggcaagggagacttcgagaatgctggcacccatagcgacatctgccctgagctgctcagcaggcaggcagcagcctcccgcacccatgggagagagttttgttttcttggccgggctgggcaggccgctgttctcccaagctcggggccatgccgtgccaccgtcaccagagccagctgcagcactggggcagccactgtcgccggacttggggaagcccagggtgaagacagtcactcatccgtgcaagctctccagaaggaagggatgcaagctctccagaaggggtgtgatctctgagcagtggggagtggagtcaccactcgggacatagagggtggacagttcaggcctgtgtctgcctccttgggactgtggagtgggtgccctcagtaaagcgctttgttggaatggt

SEQ ID NO: 354896 - DNA, 3152 bp, Homo sapiens
gagcagagccaacgtgtcagcggcgcccaagcggccccagcgggctcgcgtcgccccgctctcctcaccgagccgccaatcggctcaggatccgcccctgacgacgcgggccccgcccctggagacacgcgccgcgcagtcgtcacccgcccgggatcaggaggccgggggcgcccgccggtcgggcctgggcggccgccatgaagctgacgcggaagatggttctgacccgggccaaggcctcggagctgcacagcgtgcgcaagctcaactgctggggcagccgcctcacagatatctccatttgccaggagatgcccagcctggaggtgatcacgctcagtgtcaacagcatctccaccctggagcctgtgagccggtgccagcgcctgagtgagctgtacctgcggaggaaccgcatccccagcctggctgagctcttctacctgaaggggctgccgcgtctgcgggtgctgtggctggccgagaacccgtgctgcggcaccagcccccaccgctaccgcatgaccgtgctgcgcaccctgccgcgcctacagaagctggacaaccaggctgtgacggaggaggagctgtcccgtgcactgagtgagggagaggagatcactgcggccccagagagagagggcacaggccacggcggccccaagctatgctgcacactgagctccctcagctccgctgctgagactggccgggacccgctggacagcgaggaggaggcaacgtgaggctggagggcagcggggactccgcagcccatccctgtcccccagggtcctcccacggggagtgaatggggcttcccgtgagctgcgtctctgggaagtgagggacagggattatccggggggagtgtctgttctcatccatattctctgggagtgactcagtgcccaggtagtgatttcagtggcaggtccatgttttgcccaacagcggatgtgccagggagcaggagagggggtgagccaggccccgtgccctggcacagagaaggctcacagcaccagagctcgtgaggtgcagggagcccctggtggggggggtggcctagggccacagtgactggaatggtttgtgggcacggccatcagtgcccgtatggccttgggcctgggggccgtggaggggccacagggctgactctgcagtgagacgccggcgcctcccagggcagttggcagcgggtcacgaacgcatttgacagaagctgggcacttctctcctgcttggcagatcacacccgctgctggtgcctgtggtgggggcatcgggatgtgatctctgttaggcatctgccatccggcacagggcctgaccccatggtcaggagctctcccccggcatttgtgtgttcgggtgccccccaccctgcccctgaagccctgggtggaaggtgttacagctggggagccccagggtgccgggagggcgccccacaggtgaagtaagtgccgggctctccaggagctgccatctgtagcccctgacctcccaggagttgcctcccttctcttgcccccgtgtgccaggtgggatttgtatgagcccctcctttgcttggatgcgacccgcagacagggtttgcagaggcccccccggtgccacgagccccctgaccctcacacgcctttgtctccctctcagcagcggcgcccaggatgaacgtggcctgaagccgccttcccggggccagtttccttccctctcagccagggatgcctcgagcagccacaggggcaggaacgtcctgactgccatcctgctgctgctgcgggagctggatgcagaggggctggaggccgtgcagcagactgtgggcagccggctgcaggccctgcgtggggaagaggtgcaggagcacgccgagtgaccgcaggacctgaacgccgctccagcctccacggggaccccagcgtcttccccagcccccgggagctggagggtggctgccatggccgcagccccggccccacacaaaagcctccccggtttgccacatcggccgagggcaggagtgggtgttaggtactggctaaccggggcggtggagatgcctgtctacaccagtcctgtccccaggactccccttctgtggtctggaggttctaggctggcctgggctcttaaagggaggattttgcaggctgtcctccctaataaaagattttcccaaggttgatctggaggtgacgtttcccaaggcatggttgtgacagtcttcctgaaagcaagggccgtttctccacagaatgaggaggtcttcacggatggctttgccgattccagcccttggtccttggatagatttctgttgggcaagggagacttcgagaatgctggcacccatagcgacatctgccctgagctgctcagcaggcaggcagcagcctcccgcacccatgggagagagttttgttttcttggccgggctgggcaggtgcgccttcctttctctctcctgtgaagaactgcaggagggccctcagctgtgaggttgtggatgaacaggcctgttcgccctggggtccgggcctggcacaggaagcagctagactaggggagtccttggagcatctgagaggggttttctttcctctgggaagagtcgcaagtcttatgaggatgccacaatctgggcagtgacccgtggccctggggaccttcctagtgccccccaaaaccaaggaagcattcacgtgagatggggagtcagccttccagctggtgtgtaggaaagccaggtccctgggcccttgtcccatgtggggttgagatccagatctccatgagatattcccatcctccgccgagcggtgatgcgtgaccgtgtgtgcaggccgctgttctcccaagctcggggccatgccgtgccaccgtcaccagagccagctgcagcactggggcagccactgtcgccggacttggggaagcccagggtgaagacagtcactcatccgtgcaagctctccagaaggaagggatgcaagctctccagaaggggtgtgatctctgagcagtggggagtggagtcaccactcgggacatagagggtggacagttcaggcctgtgtctgcctccttgggactgtggagtgggtgccctcagtaaagcgctttgttggaatggt

SEQ ID NO: 354897 - DNA, 3759 bp, Homo sapiens
gagcagagccaacgtgtcagcggcgcccaagcggccccagcgggctcgcgtcgccccgctctcctcaccgagccgccaatcggctcaggatccgcccctgacgacgcgggccccgcccctggagacacgcgccgcgcagtcgtcacccgcccgggatcaggaggccgggggcgcccgccggtcgggcctgggcggccgccatgaagctgacgcggaagatggttctgacccgggccaaggcctcggagctgcacagcgtgcgcaagctcaactgctggggcagccgcctcacagatatctccatttgccaggagatgcccagcctggaggtgatcacgctcagtgtcaacagcatctccaccctggagcctgtgagccggtgccagcgcctgagtgagctgtacctgcggaggaaccgcatccccagcctggctgagctcttctacctgaaggggctgccgcgtctgcgggtgctgtggctggccgagaacccgtgctgcggcaccagcccccaccgctaccgcatgaccgtgctgcgcaccctgccgcgcctacagaagctggacaaccaggatgtgtcctgtgaagtctcctccagaggctgttcccctggcttctgtgtctcctcttgatcccgccacccgaatgcagcagcgcagcgtagggtccctcctgggactgacacgccagcaccgacacagttttccaggctgtggtttcatgctgtttgttcatccttggcattctcagcacactagtgtctcatccttgtcaggtatacagacaccactattttctcccagacaattttattgatattaataatataaacttcagggaaattgatatatgagagaaatggaataaattcaatatggtctgttcctttttctattgtgtcgtagttgaggttttgaggagtatttgcttctggccaaggctggtgttgagattcctgagcagccctccaccatctgttgtgtgtcagcctgtgccaggctggggatgggacagtgaggaaccggctgctactctgggagttgtccctggaggtggatacacgtgcatgcatttcacaagcagactgtgcctgaagccacagtgaggacgggagctgcagtgcatgtggcctgcacgtgggtgaggccactcatgctgtcttctgtctttcatcccaaagctgtgacggaggaggagctgtcccgtgcactgagtgagggagaggagatcactgcggccccagagagagagggcacaggccacggcggccccaagctatgctgcacactgagctccctcagctccgctgctgagactggccgggacccgctggacagcgaggaggaggcaacgtgaggctggagggcagcggggactccgcagcccatccctgtcccccagggtcctcccacggggagtgaatggggcttcccgtgagctgcgtctctgggaagtgagggacagggattatccggggggagtgtctgttctcatccatattctctgggagtgactcagtgcccaggtagtgatttcagtggcaggtccatgttttgcccaacagcggatgtgccagggagcaggagagggggtgagccaggccccgtgccctggcacagagaaggctcacagcaccagagctcgtgaggtgcagggagcccctggtggggggggtggcctagggccacagtgactggaatggtttgtgggcacggccatcagtgcccgtatggccttgggcctgggggccgtggaggggccacagggctgactctgcagtgagacgccggcgcctcccagggcagttggcagcgggtcacgaacgcatttgacagaagctgggcacttctctcctgcttggcagatcacacccgctgctggtgcctgtggtgggggcatcgggatgtgatctctgttaggcatctgccatccggcacagggcctgaccccatggtcaggagctctcccccggcatttgtgtgttcgggtgccccccaccctgcccctgaagccctgggtggaaggtgttacagctggggagccccagggtgccgggagggcgccccacaggtgaagtaagtgccgggctctccaggagctgccatctgtagcccctgacctcccaggagttgcctcccttctcttgcccccgtgtgccaggtgggatttgtatgagcccctcctttgcttggatgcgacccgcagacagggtttgcagaggcccccccggtgccacgagccccctgaccctcacacgcctttgtctccctctcagcagcggcgcccaggatgaacgtggcctgaagccgccttcccggggccagtttccttccctctcagccagggatgcctcgagcagccacaggggcaggaacgtcctgactgccatcctgctgctgctgcgggagctggatgcagaggggctggaggccgtgcagcagactgtgggcagccggctgcaggccctgcgtggggaagaggtgcaggagcacgccgagtgaccgcaggacctgaacgccgctccagcctccacggggaccccagcgtcttccccagcccccgggagctggagggtggctgccatggccgcagccccggccccacacaaaagcctccccggtttgccacatcggccgagggcaggagtgggtgttaggtactggctaaccggggcggtggagatgcctgtctacaccagtcctgtccccaggactccccttctgtggtctggaggttctaggctggcctgggctcttaaagggaggattttgcaggctgtcctccctaataaaagattttcccaaggttgatctggaggtgacgtttcccaaggcatggttgtgacagtcttcctgaaagcaagggccgtttctccacagaatgaggaggtcttcacggatggctttgccgattccagcccttggtccttggatagatttctgttgggcaagggagacttcgagaatgctggcacccatagcgacatctgccctgagctgctcagcaggcaggcagcagcctcccgcacccatgggagagagttttgttttcttggccgggctgggcaggtgcgccttcctttctctctcctgtgaagaactgcaggagggccctcagctgtgaggttgtggatgaacaggcctgttcgccctggggtccgggcctggcacaggaagcagctagactaggggagtccttggagcatctgagaggggttttctttcctctgggaagagtcgcaagtcttatgaggatgccacaatctgggcagtgacccgtggccctggggaccttcctagtgccccccaaaaccaaggaagcattcacgtgagatggggagtcagccttccagctggtgtgtaggaaagccaggtccctgggcccttgtcccatgtggggttgagatccagatctccatgagatattcccatcctccgccgagcggtgatgcgtgaccgtgtgtgcaggccgctgttctcccaagctcggggccatgccgtgccaccgtcaccagagccagctgcagcactggggcagccactgtcgccggacttggggaagcccagggtgaagacagtcactcatccgtgcaagctctccagaaggaagggatgcaagctctccagaaggggtgtgatctctgagcagtggggagtggagtcaccactcgggacatagagggtggacagttcaggcctgtgtctgcctccttgggactgtggagtgggtgccctcagtaaagcgctttgttggaatggt

SEQ ID NO: 354898 - DNA, 1624 bp, Homo sapiens
ccgggccctgctgggctgagggcaacaggagtcacgtggaagaggtgccacacacgcgtccacaggcggggctcctctgctcagattctccgagtgtgccggtcagtcacttggacggcccacacccccgggaccagtcgctccgtggtggggcaccgctggccaggccccagcccttgtggagggaagcagcctcgctgtgccgggtgggcttagtccgcacccctctgccctcagaacgtcctgactgccatcctgctgctgctgcgggagctggatgcagaggggctggaggccgtgcagcagactgtgggcagccggctgcaggccctgcgtggggaagaggtgcaggagcacgccgagtgaccgcaggacctgaacgccgctccagcctccacggggaccccagcgtcttccccagcccccgggagctggagggtggctgccatggccgcagccccggccccacacaaaagcctccccggtttgccacatcggccgagggcaggagtgggtgttaggtactggctaaccggggcggtggagatgcctgtctacaccagtcctgtccccaggactccccttctgtggtctggaggttctaggctggcctgggctcttaaagggaggattttgcaggctgtcctccctaataaaagattttcccaaggttgatctggaggtgacgtttcccaaggcatggttgtgacagtcttcctgaaagcaagggccgtttctccacagaatgaggaggtcttcacggatggctttgccgattccagcccttggtccttggatagatttctgttgggcaagggagacttcgagaatgctggcacccatagcgacatctgccctgagctgctcagcaggcaggcagcagcctcccgcacccatgggagagagttttgttttcttggccgggctgggcaggtgcgccttcctttctctctcctgtgaagaactgcaggagggccctcagctgtgaggttgtggatgaacaggcctgttcgccctggggtccgggcctggcacaggaagcagctagactaggggagtccttggagcatctgagaggggttttctttcctctgggaagagtcgcaagtcttatgaggatgccacaatctgggcagtgacccgtggccctggggaccttcctagtgccccccaaaaccaaggaagcattcacgtgagatggggagtcagccttccagctggtgtgtaggaaagccaggtccctgggcccttgtcccatgtggggttgagatccagatctccatgagatattcccatcctccgccgagcggtgatgcgtgaccgtgtgtgcaggccgctgttctcccaagctcggggccatgccgtgccaccgtcaccagagccagctgcagcactggggcagccactgtcgccggacttggggaagcccagggtgaagacagtcactcatccgtgcaagctctccagaaggaagggatgcaagctctccagaaggggtgtgatctctgagcagtggggagtggagtcaccactcgggacatagagggtggacagttcaggcctgtgtctgcctccttgggactgtggagtgggtgccctcagtaaagcgctttgttggaatggt

SEQ ID NO: 354899 - DNA, 1084 bp, Homo sapiens
gagcagagccaacgtgtcagcggcgcccaagcggccccagcgggctcgcgtcgccccgctctcctcaccgagccgccaatcggctcaggatccgcccctgacgacgcgggccccgcccctggagacacgcgccgcgcagtcgtcacccgcccgggatcaggaggccgggggcgcccgccggtcgggcctgggcggccgccatgaagctgacgcggaagatggttctgacccgggccaaggcctcggagctgcacagcgtgcgcaagctcaactgctggggcagccgcctcacagatatctccatttgccaggagatgcccagcctggaggtgatcacgctcaggtacctcgctcctgctgtcatgctcagcctggggcctggaagccggggcagagcctcacgtccctccagtgggacccagcactgtgacataacctggaaacctccaacacagactgagggcggcttccagaaggggaggggccgggacagcgagagctgggcctaccctgtggcccccatgttcagccctccttcctcagagcctcacctgggcctcctgatggctcctgtcccctgcctgccctgctgtacgcctgcccacccttggcctgtgtgctccgataagccattgctgtgttcactgggccagtcggtggtggagccctcctaaggattcacggtggcccgccctggccgcccccacggtggccacatctgccctgggacccccagagtcctggcctcttctgccccccagtgccaccactgcctaccagtttctctgcaccccatgacctgtgcccgtcttctggggtcactgccctcccagcagactaagggaagcttgaatgaacaaatgttactggactttcaggcagttggggtgtatttgggggctctggggaagagaagagctccctttatccctgaattccctcctgcctactgtgggacccacggagggagcagacgctcatggctcaccactgcccaccagacgctggatgggcgccttctgtgggtttccgcatttaaaagctcacaagggtttaaaccctgtggggaaggcccacccctctg

SEQ ID NO: 354900 - DNA, 397 bp, Homo sapiens
tatatcttattggttacccactgggtctactgccaagttctgcagttttctcatttgctgggccttcagggctgtctctaccatttggattaatttatgtaattctaggctagagctatttttacttagtcaacttgtcttttgcattgtgtcaggaaaagtcagctactaaatcatttttttgtttagaagtctataacgactcctaagtatctttatgtcactctctaaacctggaacaccttgactacacaagttgaattatatcaatcttcttccatatgcttgagaattacctctttcatgaagcctcagaaacttgcctattccaattattttaggactttctttagctttagcacttctattcaattttacgctttttgtttttgttttt

SEQ ID NO: 354901 - DNA, 1284 bp, Homo sapiens
aagatgacttccccatgaagtcttatcagggacctgggagagaccttggtgttttaccaccactgtgtgttgcccagaggcgcatttgtgagtagccagggcaggacttagaaaagtcggtgtgtctggtgaaaggtagctgatctgaagggtagcaagtaatgcaaaagcactaatttgctaagccctgtctgtgatccagtaagactggctatctggcttttggaaaattaatttcctcaacgctggttcacaaaatcaccaatttaccacatactgacaatagtttgttatatctggggttcaccttcagaggcagggagtgggaaaggaaataagaaaccacttaaggaaagcctacccattcaaaccaattagattgtgcattctaaaagggctcagcttctggatgtaaaatgtaagcaacactgacattagactgttgatctgacaagtctataatgacttaagtgatgccatgataaaaccaaaatattggggaaaatatttggcaaattattctaagaatatgccaatttggataaagtggtcatttggagaactggtttttaggaaagtggcctacttactccactgaggctgctaggggaaatagtcccagcccctcacaggtatggtgcccattccagccatgaaggctgacacaagaggaggttgccaggagctcacccatgaagctaccagaagaaggcagaaaacccactgtatggctatcccatgaagctagaggaagggcaagctggtggggggacagcctctgagaggcagcatggacagactctgtcctgccaaagtcctcacacagcccacacaggtgatttgaggtacaccccaagtgcctggcagctaaacacattgccattagtgccacatcatttagcttaaggctctactaagtcagtaattactttagtggcattatgagtaagtacagatgaactggcagtcgcttcaggaaagggacacatggtgagtcctgatgatgggcagggagggaaggaaggtggggtgtcgggccctgcagtggggtgtgggggagctgcagaaccttggagcaaacatacctcccttgtgactcccacatcaaccattaaagttatttaacagcagccttcacctggctcctgaggaaaaaaaacctctctctgcctggtctagacctgcctcacatcatccctggagcatagttcaccagctgtgaaacatgactgtgatactgagtaatcagacaaaggctgggtggagcgggtactttatgaatac

SEQ ID NO: 354902 - DNA, 984 bp, Homo sapiens
  misc_feature (881)..(881): n is a, c, g, or t
  misc_feature (885)..(885): n is a, c, g, or t
  misc_feature (897)..(897): n is a, c, g, or t
  misc_feature (899)..(899): n is a, c, g, or t
  misc_feature (902)..(902): n is a, c, g, or t
  misc_feature (905)..(905): n is a, c, g, or t
  misc_feature (907)..(907): n is a, c, g, or t
  misc_feature (916)..(916): n is a, c, g, or t
  misc_feature (927)..(927): n is a, c, g, or t
  misc_feature (929)..(929): n is a, c, g, or t
  misc_feature (934)..(935): n is a, c, g, or t
  misc_feature (953)..(953): n is a, c, g, or t
  misc_feature (958)..(958): n is a, c, g, or t
gggacagctcggaggagctggggcggagccgcagggcctggcggccgccgagtgaagtgtgactccgtgggcctggcgtggaggcgggggcgctaggctgcagctggctcggaatcggggctggtttcctgtctggaagggaaggggcctgcagaagggagcggggacagcagcagacaggcacacccctgccttcctctctccctctcctcccttctctggaaaagcgaggacacggagttgcagaggaagctagaccatgagatccggatgagggaaggggcctgtaagctgctggcagcctgctcccagcgagagcaggctctggaggccaccaagagcctgctagtgtgcaacagccgcatcctcagctacatgggcgagctgcagcggcgcaaggaggcgcaggtgctggggaagacaagccggcggccttctgacagtggcccgcccgctgagcgctccccctgccgcggccgggtctgcatctctgacctccggattccactcatgtggaaggacacagaatatttcaagaacaaaggtgacttgcaccgctgggctgtgttcctgctgctgcagctgggggaacacatccaggacacagagatgatcctagtggacaggaccctcacagacatctcctttcagagcaatgtgctcttcgctgaggcggggccagactttgaactgcggttagagctgtatggggcctgtgtggaagaagagggggccctgactggcggccccaagaggcttgccaccaaactcagcagctccctgggccgctcctcagggaggcgtgtccgggcatcgctggacagtgctgggggttcagggagcagtcccatcttgctccccaccccagttgttggtggtcncgtnacactcttggtncnacnaantnacctggcgngtgcagatggntncgganntgactcccttgcgtctgngaganctgcctgtgcctttggtcgttgtcgg

SEQ ID NO: 354903 - DNA, 1297 bp, Homo sapiens
aagatgacttccccatgaagtcttatcagggacctgggagagaccttggtgttttaccaccactgtgtgttgcccagaggcgcatttgtgagtagccagggcaggacttagaaaagtcggtgtgtctggtgaaaggtagctgatctgaagggtagcaagtaatgcaaaagcactaatttgctaagccctgtctgtgatccagtaagactggctatctggcttttggaaaattaatttcctcaacgctggttcacaaaatcaccaatttaccacatactgacaatagtttgttatatctggggttcaccttcagaggcagggagtgggaaaggaaataagaaaccacttaaggaaagcctacccattcaaaccaattagattgtgcattctaaaagggctcagcttctggatgtaaaatgtaagcaacactgacattagactgttgatctgacaagtctataatgacttaagtgatgccatgataaaaccaaaatattggggaaaatatttggcaaattattctaagaatatgccaatttggataaagtggtcatttggagaactggtttttaggaaagtggcctacttactccactgaggctgctaggggaaatagtcccagcccctcacaggtatggtgcccattccagccatgaaggctgacacaagaggaggttgccaggagctcacccatgaagctaccagaagaaggcagaaaacccactgtatggctatcccatgaagctagaggaagggcaagctggtggggggacagcctctgagaggcagcatggacagactctgtcctgccaaagtcctcacacagcccacacaggtgatttgaggtacaccccaagtgcctggcagctaaacacattgccattagtgccacatcatttagcttaaggctctactaagtcagtaattactttagtggcattatgagtaagtacagatgaactggcagtcgcttcaggaaagggacacatggtgagtcctgatgatgggcagggagggaaggaaggtggggtgtcgggccctgcagtggggtgtgggggagctgcagaacttggggcactagtagggtacaccatatcaggccaggaggaaaaaggagaaatcaaagttggggagtggtagggaaggaaaagggtctgtagtgaatggaacgtaactcttccctattggtgattttcctttgaacaaatgttggccaaattattttctgacccagtaccctcctatatcaaagaagtgatgggatggtgggaaataagcagctttcctattgttaaaa

SEQ ID NO: 354904 - DNA, 1108 bp, Homo sapiens
aagatgacttccccatgaagtcttatcagggacctgggagagaccttggtgttttaccaccactgtgtgttgcccagaggcgcatttgtgagtagccagggcaggacttagaaaagtcggtgtgtctggtgaaaggtagctgatctgaagggtagcaagtaatgcaaaagcactaatttgctaagccctgtctgtgatccagtaagactggctatctggcttttggaaaattaatttcctcaacgctggttcacaaaatcaccaatttaccacatactgacaatagtttgttatatctggggttcaccttcagaggcagggagtgggaaaggaaataagaaaccacttaaggaaagcctacccattcaaaccaattagattgtgcattctaaaagggctcagcttctggatgtaaaatgtaagcaacactgacattagactgttgatctgacaagtctataatgacttaagtgatgccatgataaaaccaaaatattggggaaaatatttggcaaattattctaagaatatgccaatttggataaagtggtcatttggagaactggtttttaggaaagtggcctacttactccactgaggctgctaggggaaatagtcccagcccctcacaggtatggtgcccattccagccatgaaggctgacacaagaggaggttgccaggagctcacccatgaagctaccagaagaaggcagaaaacccactgtatggctatcccatgaagctagaggaagggcaagctggtggggggacagcctctgagaggcagcatggacagactctgtcctgccaaagtcctcacacagcccacacaggtggggtgtcgggccctgcagtggggtgtgggggagctgcagaacttggggcactagtagggtacaccatatcaggccaggaggaaaaaggagaaatcaaagttggggagtggtagggaaggaaaagggtctgtagtgaatggaacgtaactcttccctattggtgattttcctttgaacaaatgttggccaaattattttctgacccagtaccctcctatatcaaagaagtgatgggatggtgggaaataagcagctttcctattgttaaaa

SEQ ID NO: 354905 - DNA, 661 bp, Homo sapiens
ggcccaggtgaggggctgctcctgcaggataacgcaatctccactgagatccaggctttgctttcctcctattacagtgacaggtgatagggctgggtaggcttggggcctgagctctgactagcccaaccctcccccaaccccttcctggtgccacagctattgagccgctggatgacatcgcagcggtgacagacatcctgacccagcgggagggcgcaaggctggagacacccccaccctggctggcaatgtttacagaccagcctgccctgcctaacccctgctcgcctgcaagcccctcttaaattgtggttgccatggtaccgagggactcattcctggggctcgctgggacctccctaaacccttcctggaagaaaactggaaccaactctgccctacctccctgcactaaccagctttgaggatggcactgaagaacccttggagcaaacatacctcccttgtgactcccacatcaaccattaaagttatttaacagcagccttcacctggctcctgaggaaaaaaaacctctctctgcctggtctagacctgcctcacatcatccctggagcatagttcaccagctgtgaaacatgactgtgatactgagtaatcagacaaaggctgggtggagcgggtactttatgaatac

SEQ ID NO: 354906 - DNA, 2326 bp, Homo sapiens
gggacagctcggaggagctggggcggagccgcagggcctggcggccgccgagtgaagtgtgactccgtgggcctggcgtggaggcgggggcgctaggctgcagctggctcggaatcggggctggtttcctgtctggaagggaaggggcctgcagaagggagcggggacagcagcagacaggcacacccctgccttcctctctccctctcctcccttctctggaaaagcgaggacacggagttgcagaggaagctagaccatgagatccggatgagggaaggggcctgtaagctgctggcagcctgctcccagcgagagcaggctctggaggccaccaagagcctgctagtgtgcaacagccgcatcctcagctacatgggcgagctgcagcggcgcaaggaggcgcaggtgctggggaagacaagccggcggccttctgacagtggcccgcccgctgagcgctccccctgccgcggccgggtctgcatctctgacctccggattccactcatgtggaaggacacagaatatttcaagaacaaaggtgacttgcaccgctgggctgtgttcctgctgctgcagctgggggaacacatccaggacacagagatgatcctagtggacaggaccctcacagacatctcctttcagagcaatgtgctcttcgctgaggcggggccagactttgaactgcggttagagctgtatggggcctgtgtggaagaagagggggccctgactggcggccccaagaggcttgccaccaaactcagcagctccctgggccgctcctcagggaggcgtgtccgggcatcgctggacagtgctgggggttcagggagcagtcccatcttgctccccaccccagttgttggtggtcctcgttaccacctcttggctcacaccacactcaccctggcagcagtgcaagatggattccgcacacatgacctcacccttgccagtcatgaggagaaccctgcctggctgcccctttatggtagcgtgtgttgccgtctggcagctcagcctctctgcatgactcagcccactgcaagtggtaccctcagggtgcagcaagctggggagatgcagaactgggcacaagtgcatggagttctgaaaggcacaaacctcttctgttaccggcaacctgaggatgcagacactggggaagagccgctgcttactattgctgtcaacaaggagactcgagtccgggcaggggagctggaccaggctctaggacggcccttcaccctaagcatcagtaaccagtatggggatgatgaggtgacacacacccttcagacagaaagtcgggaagcactgcagagctggatggaggctctgtggcagcttttctttgacatgagccaatggaagcagtgctgtgatgaaatcatgaaaattgaaactcctgctccccggaaaccaccccaagcactggcaaagcaggggtccttgtaccatgagatggctattgagccgctggatgacatcgcagcggtgacagacatcctgacccagcgggagggcgcaaggctggagacacccccaccctggctggcaatgtttacagaccagcctgccctgcctaacccctgctcgcctgcctcagtggccccagccccagactggacccaccccctgccctgggggagaccccgaaccttttccctggatgctgtccccccagaccactcccctagggctcgctcggttgcccccctcccacctcagcgatccccacggaccagaggcctctgcagcaaaggccaacctcgcacttggctccagtcaccagtgtgagagagaaaggtgctggcataggatctgcccagaagagaaaatgacccatgcgcagttgggctctggatacggcgctgtctatagcaagttggccagtctggcctcctgttcctctgctggacctggggtaggctgcaggggtgggcagaagcccctcttaaattgtggttgccatggtaccgagggactcattcctggggctcgctgggacctccctaaacccttcctggaagaaaactggaaccaactctgccctacctccctgcactaaccagctttgaggatggcactgaagaacccttggagcaaacatacctcccttgtgactcccacatcaaccattaaagttatttaacagcagccttcacctggctcctgaggaaaaaaaacctctctctgcctggtctagacctgcctcacatcatccctggagcatagttcaccagctgtgaaacatgactgtgatactgagtaatcagacaaaggctgggtggagcgggtactttatgaatac

SEQ ID NO: 354907 - DNA, 3662 bp, Homo sapiens
gggacagctcggaggagctggggcggagccgcagggcctggcggccgccgagtgaagtgtgactccgtgggcctggcgtggaggcgggggcgctaggctgcagctggctcggaatcggggctggtttcctgtctggaagggaaggggcctgcagaagggagcggggacagcagcagacaggcacacccctgccttcctctctccctctcctcccttctctggaaaagcgagctgggagaacagctgccaccaaagcgagactggacactctgtgcctagagccccctctgcagctggcctttcctcctgggaccccacttatcctcacttcgctttctttttcttccctgcctggctcccggcagggccccggagcagcagtgggcgaggaaaatttgtcacagcagccagaggggtttaacaggagtgcagagggataagggcagcttctgccctctgcccaagagctggccacctctttaaagactgagggaacagtgggaggaggaactgtgggacagtgtggtacctatctgtcccccctctggaggggttgacaagggaaagggcaccggggggcacagagatgcaggacagattgcacatcctggaggacctgaatatgctctacattcggcagatggcactcagcctggaggacacggagttgcagaggaagctagaccatgagatccggatgagggaaggggcctgtaagctgctggcagcctgctcccagcgagagcaggctctggaggccaccaagagcctgctagtgtgcaacagccgcatcctcagctacatgggcgagctgcagcggcgcaaggaggcgcaggtgctggggaagacaagccggcggccttctgacagtggcccgcccgctgagcgctccccctgccgcggccgggtctgcatctctgacctccggattccactcatgtggaaggacacagaatatttcaagaacaaaggtgacttgcaccgctgggctgtgttcctgctgctgcagctgggggaacacatccaggacacagagatgatcctagtggacaggaccctcacagacatctcctttcagagcaatgtgctcttcgctgaggcggggccagactttgaactgcggttagagctgtatggggcctgtgtggaagaagagggggccctgactggcggccccaagaggcttgccaccaaactcagcagctccctgggccgctcctcagggaggcgtgtccgggcatcgctggacagtgctgggggttcagggagcagtcccatcttgctccccaccccagttgttggtggtcctcgttaccacctcttggctcacaccacactcaccctggcagcagtgcaagatggattccgcacacatgacctcacccttgccagtcatgaggagaaccctgcctggctgcccctttatggtagcgtgtgttgccgtctggcagctcagcctctctgcatgactcagcccactgcaagtggtaccctcagggtgcaggtgagggggccctgaggagtggaagggagcagggagaaggcagaggagagctggataaccaggaatagaagagctaatgaaaaatcaagatttgggtggaagaaatggggtatggccagacgaggggaggaatggacagcagggtggacaaaacgaacaggttctcatggggggctgagaagagggatactgggggccgtgacttccccagaaaatgttgagtcatttgtgcagcaagctggggagatgcagaactgggcacaagtgcatggagttctgaaaggcacaaacctcttctgttaccggcaacctgaggatgcagacactggggaagagccgctgcttactattgctgtcaacaaggtgatgggtcccttggtagtaaggccaccaagggcacaggcccaggagcctctccttcaggccccaggagggtgggcacatacctcagagagatagaagcaggcctcctgctcctgacagtgccacatccagcttcaggggcccgtattttccccaactacagcatcactgtgagaggatcgtcccattcacttgccatcctcagtccctgccaaatctcagagagggttctctcgcctgcaggttcagggcttttcatcctctctccctcttctccctcagattccaatttatatctactttaccacttcccatttctctccaggtccaattgcccttctttgctccctatcccttttatgggctttcctgcctactttttgtcagttctgagggacctctggctggagcatccttgcctacctttgtgtcttccctgccttgctcaatccctttttccctgtctcaagctgctcctcctcccctgactcaggactggctgtctcatccccagcccttttttgccattccttcctactctggtcagtaggaggcaaatgagagggctcagcaaaagccccacaagctcattcttctaaggcaggcgtgatcaaggctgcctgattgtcactgccaacttctgtgaccaaggtagacctcttctttctcctgcaggagactcgagtccgggcaggggagctggaccaggctctaggacggcccttcaccctaagcatcagtaaccagtatggggatgatgaggtgacacacacccttcagacagaaagtcgggaagcactgcagagctggatggaggctctgtggcagcttttctttgacatgagccaatggaagcagtgctgtgatgaaatcatgaaaattgaaactcctgctccccggaaaccaccccaagcactggcaaagcaggggtccttgtaccatgagatggctattgagccgctggatgacatcgcagcggtgacagacatcctgacccagcgggagggcgcaaggctggagacacccccaccctggctggcaatgtttacagaccagcctgccctgcctaacccctgctcgcctgcctcagtggccccagccccagactggacccaccccctgccctgggggagaccccgaaccttttccctggatgctgtccccccagaccactcccctagggctcgctcggttgcccccctcccacctcagcgatccccacggaccagaggcctctgcagcaaaggccaacctcgcacttggctccagtcaccagtgtgagagagaaaggtgctggcataggatctgcccagaagagaaaatgacccatgcgcagttgggctctggatacggcgctgtctatagcaagttggccagtctggcctcctgttcctctgctggacctggggtaggctgcaggggtgggcagaagcccctcttaaattgtggttgccatggtaccgagggactcattcctggggctcgctgggacctccctaaacccttcctggaagaaaactggaaccaactctgccctacctccctgcactaaccagctttgaggatggcactgaagaacccttggagcaaacatacctcccttgtgactcccacatcaaccattaaagttatttaacagcagccttcacctggctcctgaggaaaaaaaacctctctctgcctggtctagacctgcctcacatcatccctggagcatagttcaccagctgtgaaacatgactgtgatactgagtaatcagacaaaggctgggtggagcgggtactttatgaatac

SEQ ID NO: 354908 - DNA, 3180 bp, Homo sapiens
gggacagctcggaggagctggggcggagccgcagggcctggcggccgccgagtgaagtgtgactccgtgggcctggcgtggaggcgggggcgctaggctgcagctggctcggaatcggggctggtttcctgtctggaagggaaggggcctgcagaagggagcggggacagcagcagacaggcacacccctgccttcctctctccctctcctcccttctctggaaaagcgagctgggagaacagctgccaccaaagcgagactggacactctgtgcctagagccccctctgcagctggcctttcctcctgggaccccacttatcctcacttcgctttctttttcttccctgcctggctcccggcagggccccggagcagcagtgggcgaggaaaatttgtcacagcagccagaggggtttaacaggagtgcagagggataagggcagcttctgccctctgcccaagagctggccacctctttaaagactgagggaacagtgggaggaggaactgtgggacagtgtggtacctatctgtcccccctctggaggggttgacaagggaaagggcaccggggggcacagagatgcaggacagattgcacatcctggaggacctgaatatgctctacattcggcagatggcactcagcctggaggacacggagttgcagaggaagctagaccatgagatccggatgagggaaggggcctgtaagctgctggcagcctgctcccagcgagagcaggctctggaggccaccaagagcctgctagtgtgcaacagccgcatcctcagctacatgggcgagctgcagcggcgcaaggaggcgcaggtgctggggaagacaagccggcggccttctgacagtggcccgcccgctgagcgctccccctgccgcggccgggtctgcatctctgacctccggattccactcatgtggaaggacacagaatatttcaagaacaaaggtgacttgcaccgctgggctgtgttcctgctgctgcagctgggggaacacatccaggacacagagatgatcctagtggacaggaccctcacagacatctcctttcagagcaatgtgctcttcgctgaggcggggccagactttgaactgcggttagagctgtatggggcctgtgtggaagaagagggggccctgactggcggccccaagaggcttgccaccaaactcagcagctccctgggccgctcctcagggaggcgtgtccgggcatcgctggacagtgctgggggttcagggagcagtcccatcttgctccccaccccagttgttggtggtcctcgttaccacctcttggctcacaccacactcaccctggcagcagtgcaagatggattccgcacacatgacctcacccttgccagtcatgaggagaaccctgcctggctgcccctttatggtagcgtgtgttgccgtctggcagctcagcctctctgcatgactcagcccactgcaagtggtaccctcagggtgcagcaagctggggagatgcagaactgggcacaagtgcatggagttctgaaaggcacaaacctcttctgttaccggcaacctgaggatgcagacactggggaagagccgctgcttactattgctgtcaacaaggagactcgagtccgggcaggggagctggaccaggctctaggacggcccttcaccctaagcatcagtaaccagtatggggatgatgaggtgacacacacccttcagacagaaagtcgggaagcactgcagagctggatggaggctctgtggcagcttttctttgacatgagccaatggaagcagtgctgtgatgaaatcatgaaaattgaaactcctgctccccggaaaccaccccaagcactggcaaagcaggggtccttgtaccatgagatggctattgagccgctggatgacatcgcagcggtgacagacatcctgacccagcgggagggcgcaaggctggagacacccccaccctggctggcaatgtttacagaccagcctgccctgcctaacccctgctcgcctgcctcagtggccccagccccagactggacccaccccctgccctgggggagaccccgaaccttttccctggatgctgtccccccagaccactcccctagggctcgctcggttgcccccctcccacctcagcgatccccacggaccagaggcctctgcagcaaaggccaacctcgcacttggctccagtcaccagtgtgagagagaaaggtgctggcataggatctgcccagaagagaaaatgacccatgcgcagttgggctctggatacggcgctgtctatagcaagttggccagtctggcctcctgttcctctgctggacctggggtaggctgcaggggtgggcagaagcccctcttaaattgtggttgccatggtaccgagggactcattcctggggctcgctgggacctccctaaacccttcctggaagaaaactggaaccaactctgccctacctccctgcactaaccagctttgaggatggcactgaagaacccttggagcaaacatacctcccttgtgactcccacatcaaccattaaagttatttaaaaaaaaaaaacaaaaaaaaaaaaaaaacacaggcggcggggcgcgcgccccggcgccccccccgcaaacacgcctcaaaccacacaacccgcgaggggagagcgcgcgcgggccccacgcggcggcacacaggagaacaagggcgccaaacgacggtgtaccccacaagagagagaaaccgcggggacaagagaagacaaaagggcgcgggagactcttcacaaccacaatacaacaaagcgcgcccgcggcggcaacaaccgagaaggccatcggagaaacacaaaccactacaaacgcagagagactcacacacgcgagcgcgcacacacacacgaggcgagcccaccacccccccaccgccacggagcgccacacaaacgagagcgacacagacaacaaacgcaagactatgagccgccaccgaaacaacaggagagaaccaacccaagaccaaccaacacagagaacccacaaccccaacataacacacaaaggaaagaacgtcaaccacaaccaccaggtaccaacaacacagcacaaacacacccaaccagaaacccacccaaacaaaaacgaacaacaa

SEQ ID NO: 354909 - DNA, 2650 bp, Homo sapiens
gggacagctcggaggagctggggcggagccgcagggcctggcggccgccgagtgaagtgtgactccgtgggcctggcgtggaggcgggggcgctaggctgcagctggctcggaatcggggctggtttcctgtctggaagggaaggggcctgcagaagggagcggggacagcagcagacaggcacacccctgccttcctctctccctctcctcccttctctggaaaagcgagctgggagaacagctgccaccaaagcgagactggacactctgtgcctagagccccctctgcagctggcctttcctcctgggaccccacttatcctcacttcgctttctttttcttccctgcctggctcccggcagggccccggagcagcagtgggcgaggaaaatttgtcacagcagccagaggggtttaacaggagtgcagagggataagggcagcttctgccctctgcccaagagctggccacctctttaaagactgagggaacagtgggaggaggaactgtgggacagtgtggtacctatctgtcccccctctggaggggttgacaagggaaagggcaccggggggcacagagatgcaggacagattgcacatcctggaggacctgaatatgctctacattcggcagatggcactcagcctggaggacacggagttgcagaggaagctagaccatgagatccggatgagggaaggggcctgtaagctgctggcagcctgctcccagcgagagcaggctctggaggccaccaagagcctgctagtgtgcaacagccgcatcctcagctacatgggcgagctgcagcggcgcaaggaggcgcaggtgctggggaagacaagccggcggccttctgacagtggcccgcccgctgagcgctccccctgccgcggccgggtctgcatctctgacctccggattccactcatgtggaaggacacagaatatttcaagaacaaaggtgacttgcaccgctgggctgtgttcctgctgctgcagctgggggaacacatccaggacacagagatgatcctagtggacaggaccctcacagacatctcctttcagagcaatgtgctcttcgctgaggcggggccagactttgaactgcggttagagctgtatggggcctgtgtggaagaagagggggccctgactggcggccccaagaggcttgccaccaaactcagcagctccctgggccgctcctcagggaggcgtgtccgggcatcgctggacagtgctgggggttcagggagcagtcccatcttgctccccaccccagttgttggtggtcctcgttaccacctcttggctcacaccacactcaccctggcagcagtgcaagatggattccgcacacatgacctcacccttgccagtcatgaggagaaccctgcctggctgcccctttatggtagcgtgtgttgccgtctggcagctcagcctctctgcatgactcagcccactgcaagtggtaccctcagggtgcagcaagctggggagatgcagaactgggcacaagtgcatggagttctgaaaggcacaaacctcttctgttaccggcaacctgaggatgcagacactggggaagagccgctgcttactattgctgtcaacaaggagactcgagtccgggcaggggagctggaccaggctctaggacggcccttcaccctaagcatcagtaaccagtatggggatgatgaggtgacacacacccttcagacagaaagtcgggaagcactgcagagctggatggaggctctgtggcagcttttctttgacatgagccaatggaagcagtgctgtgatgaaatcatgaaaattgaaactcctgctccccggaaaccaccccaagcactggcaaagcaggggtccttgtaccatgagatggctattgagccgctggatgacatcgcagcggtgacagacatcctgacccagcgggagggcgcaaggctggagacacccccaccctggctggcaatgtttacagaccagcctgccctgcctaacccctgctcgcctgctcggttgcccccctcccacctcagcgatccccacggaccagaggcctctgcagcaaaggccaacctcgcacttggctccagtcaccagtgtgagagagaaaggtgctggcataggatctgcccagaagagaaaatgacccatgcgcagttgggctctggatacggcgctgtctatagcaagttggccagtctggcctcctgttcctctgctggacctggggtaggctgcaggggtgggcagaagcccctcttaaattgtggttgccatggtaccgagggactcattcctggggctcgctgggacctccctaaacccttcctggaagaaaactggaaccaactctgccctacctccctgcactaaccagctttgaggatggcactgaagaacccttggagcaaacatacctcccttgtgactcccacatcaaccattaaagttatttaacagcagccttcacctggctcctgaggaaaaaaaacctctctctgcctggtctagacctgcctcacatcatccctggagcatagttcaccagctgtgaaacatgactgtgatactgagtaatcagacaaaggctgggtggagcgggtactttatgaatac

SEQ ID NO: 354910 - DNA, 2147 bp, Homo sapiens
gagagaggagccctgagcttgtgccttatgtgtgagttaatgtggcttgagtgtccctggtgtccccaagcctggcaaactgctgggttcaatgaacaactttcccttatagtccctcagccctgcctgtcggcctggctgggaacctggtggctgaggcgctgggatcagggggatcctagagtcgttgggaccagagcaagggggaatagtggctagaggccaggccaggacattgtgatttatccacaggccttctgacagtggcccgcccgctgagcgctccccctgccgcggccgggtctgcatctctgacctccggattccactcatgtggaaggacacagaatatttcaagaacaaaggtgacttgcaccgctgggctgtgttcctgctgctgcagctgggggaacacatccaggacacagagatgatcctagtggacaggaccctcacagacatctcctttcagagcaatgtgctcttcgctgaggcggggccagactttgaactgcggttagagctgtatggggcctgtgtggaagaagagggggccctgactggcggccccaagaggcttgccaccaaactcagcagctccctgggccgctcctcagggaggcgtgtccgggcatcgctggacagtgctgggggttcagggagcagtcccatcttgctccccaccccagttgttggtggtcctcgttaccacctcttggctcacaccacactcaccctggcagcagtgcaagatggattccgcacacatgacctcacccttgccagtcatgaggagaaccctgcctggctgcccctttatggtagcgtgtgttgccgtctggcagctcagcctctctgcatgactcagcccactgcaagtggtaccctcagggtgcagcaagctggggagatgcagaactgggcacaagtgcatggagttctgaaaggcacaaacctcttctgttaccggcaacctgaggatgcagacactggggaagagccgctgcttactattgctgtcaacaaggagactcgagtccgggcaggggagctggaccaggctctaggacggcccttcaccctaagcatcagtaaccagtatggggatgatgaggtgacacacacccttcagacagaaagtcgggaagcactgcagagctggatggaggctctgtggcagcttttctttgacatgagccaatggaagcagtgctgtgatgaaatcatgaaaattgaaactcctgctccccggaaaccaccccaagcactggcaaagcaggggtccttgtaccatgagatggctattgagccgctggatgacatcgcagcggtgacagacatcctgacccagcgggagggcgcaaggctggagacacccccaccctggctggcaatgtttacagaccagcctgccctgcctaacccctgctcgcctgcctcagtggccccagccccagactggacccaccccctgccctgggggagaccccgaaccttttccctggatgctgtccccccagaccactcccctagggctcgctcggttgcccccctcccacctcagcgatccccacggaccagaggcctctgcagcaaaggccaacctcgcacttggctccagtcaccagtgtgagagagaaaggtgctggcataggatctgcccagaagagaaaatgacccatgcgcagttgggctctggatacggcgctgtctatagcaagttggccagtctggcctcctgttcctctgctggacctggggtaggctgcaggggtgggcagaagcccctcttaaattgtggttgccatggtaccgagggactcattcctggggctcgctgggacctccctaaacccttcctggaagaaaactggaaccaactctgccctacctccctgcactaaccagctttgaggatggcactgaagaacccttggagcaaacatacctcccttgtgactcccacatcaaccattaaagttatttaacagcagccttcacctggctcctgaggaaaaaaaacctctctctgcctggtctagacctgcctcacatcatccctggagcatagttcaccagctgtgaaacatgactgtgatactgagtaatcagacaaaggctgggtggagcgggtactttatgaatac

SEQ ID NO: 354911 - DNA, 3210 bp, Homo sapiens
  misc_feature (3096)..(3096): n is a, c, g, or t
  misc_feature (3101)..(3101): n is a, c, g, or t
  misc_feature (3104)..(3104): n is a, c, g, or t
  misc_feature (3117)..(3117): n is a, c, g, or t
  misc_feature (3209)..(3209): n is a, c, g, or t
gggacagctcggaggagctggggcggagccgcagggcctggcggccgccgagtgaagtgtgactccgtgggcctggcgtggaggcgggggcgctaggctgcagctggctcggaatcggggctggtttcctgtctggaagggaaggggcctgcagaagggagcggggacagcagcagacaggcacacccctgccttcctctctccctctcctcccttctctggaaaagcgagctgggagaacagctgccaccaaagcgagactggacactctgtgcctagagccccctctgcagctggcctttcctcctgggaccccacttatcctcacttcgctttctttttcttccctgcctggctcccggcagggccccggagcagcagtgggcgaggaaaatttgtcacagcagccagaggggtttaacaggagtgcagagggataagggcagcttctgccctctgcccaagagctggccacctctttaaagactgagggaacagtgggaggaggaactgtgggacagtgtggtacctatctgtcccccctctggaggggttgacaagggaaagggcaccggggggcacagagatgcaggacagattgcacatcctggaggacctgaatatgctctacattcggcagatggcactcagcctggaggacacggagttgcagaggaagctagaccatgagatccggatgagggaaggggcctgtaagctgctggcagcctgctcccagcgagagcaggctctggaggccaccaagagcctgctagtgtgcaacagccgcatcctcagctacatgggcgagctgcagcggcgcaaggaggcgcaggtgctggggaagacaagccggcggccttctgacagtggcccgcccgctgagcgctccccctgccgcggccgggtctgcatctctgacctccggattccactcatgtggaaggacacagaatatttcaagaacaaaggtgacttgcaccgctgggctgtgttcctgctgctgcagctgggggaacacatccaggacacagagatgatcctagtggacaggaccctcacagacatctcctttcagagcaatgtgctcttcgctgaggcggggccagactttgaactgcggttagagctgtatggggcctgtgtggaagaagagggggccctgactggcggccccaagaggcttgccaccaaactcagcagctccctgggccgctcctcagggaggcgtgtccgggcatcgctggacagtgctgggggttcagggagcagtcccatcttgctccccaccccagttgttggtggtcctcgttaccacctcttggctcacaccacactcaccctggcagcagtgcaagatggattccgcacacatgacctcacccttgccagtcatgaggagaaccctgcctggctgcccctttatggtagcgtgtgttgccgtctggcagctcagcctctctgcatgactcagcccactgcaagtggtaccctcagggtgcagcaagctggggagatgcagaactgggcacaagtgcatggagttctgaaaggcacaaacctcttctgttaccggcaacctgaggatgcagacactggggaagagccgctgcttactattgctgtcaacaaggtgatgggtcccttggtagtaaggccaccaagggcacaggcccaggagcctctccttcaggccccaggagggtgggcacatacctcagagagatagaagcaggcctcctgctcctgacagtgccacatccagcttcaggggcccgtattttccccaactacagcatcactgtgagaggatcgtcccattcacttgccatcctcagtccctgccaaatctcagagagggttctctcgcctgcaggttcagggcttttcatcctctctccctcttctccctcagattccaatttatatctactttaccacttcccatttctctccaggtccaattgcccttctttgctccctatcccttttatgggctttcctgcctactttttgtcagttctgagggacctctggctggagcatccttgcctacctttgtgtcttccctgccttgctcaatccctttttccctgtctcaagctgctcctcctcccctgactcaggactggctgtctcatccccagcccttttttgccattccttcctactctggtcagtaggaggcaaatgagagggctcagcaaaagccccacaagctcattcttctaaggcaggcgtgatcaaggctgcctgattgtcactgccaacttctgtgaccaaggtagacctcttctttctcctgcaggagactcgagtccgggcaggggagctggaccaggctctaggacggcccttcaccctaagcatcagtaaccagtatggggatgatgaggtgacacacacccttcagacagaaagtcgggaagcactgcagagctggatggaggctctgtggcagcttttctttgacatgagccaatggaagcagtgctgtgatgaaatcatgaaaattgaaactcctgctccccggaaaccaccccaagcactggcaaagcaggggtccttgtaccatgagatggctattgagccgctggatgacatcgcagcggtgacagacatcctgacccagcgggagggcgcaaggctggagacacccccaccctggctggcaatgtttacagaccagcctgccctgcctaacccctgctcgcctgcctcagtggccccagccccagactggacccaccccctgccctgggggagaccccgaaccttttccctggatgctgtccccccagaccactcccctagggctcgctcggttgcccccctcccacctcagcgatccccacggaccagaggcctctgcagcaaaggccaacctcgcacttggctccagtcaccagtgtgagagagaaaggtgctggcataggatctgcccagaagagaaaatgacccatgcgcagttgggctctggatacggcgctgtctatagcaagttggccagtctggcctcctgttcctctgctggacctggggtaggctgcaggggtgggcagaagcccctcttaaattgtggttgccactgcgctncccgncgnaccccaccccccncgcgcctccgcctcgcccccccccccccccccccccgcgcccccacacccccccccccccccccccccccccccccacccaccccccccccnc

SEQ ID NO: 354912 - DNA, 2288 bp, Homo sapiens
gggacagctcggaggagctggggcggagccgcagggcctggcggccgccgagtgaagtgtgactccgtgggcctggcgtggaggcgggggcgctaggctgcagctggctcggaatcggggctggtttcctgtctggaagggaaggggcctgcagaagggagcggggacagcagcagacaggcacacccctgccttcctctctccctctcctcccttctctggaaaagcgagctgggagaacagctgccaccaaagcgagactggacactctgtgcctagagccccctctgcagctggcctttcctcctgggaccccacttatcctcacttcgctttctttttcttccctgcctggctcccggcagggccccggagcagcagtgggcgaggaaaatttgtcacagcagccagaggggtttaacaggagtgcagagggataagggcagcttctgccctctgcccaagagctggccacctctttaaagactgagggaacagtgggaggaggaactgtgggacagtgtggtacctatctgtcccccctctggaggggttgacaagggaaagggcaccggggggcacagagatgcaggacagattgcacatcctggaggacctgaatatgctctacattcggcagatggcactcagcctggaggacacggagttgcagaggaagctagaccatgagatccggatgagggaaggggcctgtaagctgctggcagcctgctcccagcgagagcaggctctggaggccaccaagagcctgctagtgtgcaacagccgcatcctcagctacatgggcgagctgcagcggcgcaaggaggcgcaggtgctggggaagacaagccggcggccttctgacagtggcccgcccgctgagcgctccccctgccgcggccgggtctgcatctctgacctccggattccactcatgtggaaggacacagaatatttcaagaacaaaggtgacttgcaccgctgggctgtgttcctgctgctgcagctgggggaacacatccaggacacagagatgatcctagtggacaggaccctcacagacatctcctttcagagcaatgtgctcttcgctgaggcggggccagactttgaactgcggttagagctgtatggggcctgtgtggaagaagagggggccctgactggcggccccaagaggcttgccaccaaactcagcagctccctgggccgctcctcagggaggcgtgtccgggcatcgctggacagtgctgggggttcagggagcagtcccatcttgctccccaccccagttgttggtggtcctcgttaccacctcttggctcacaccacactcaccctggcagcagtgcaagatggattccgcacacatgacctcacccttgccagtcatgaggagaaccctgcctggctgcccctttatggtagcgtgtgttgccgtctggcagctcagcctctctgcatgactcagcccactgcaagtggtaccctcagggtgcagcaagctggggagatgcagaactgggcacaagtgcatggagttctgaaaggcacaaacctcttctgttaccggcaacctgaggatgcagacactggggaagagccgctgcttactattgctgtcaacaaggagactcgagtccgggcaggggagctggaccaggctctaggacggcccttcaccctaagcatcagtaaccagtatggggatgatgaggtgacacacacccttcagacagaaagtcgggaagcactgcagagctggatggaggctctgtggcagcttttctttgacatgagccaatggaagcagtgctgtgatgaaatcatgaaaattgaaactcctgctccccggaaaccaccccaagcactggcaaagcaggggtccttgtaccatgagatggctattgagccgctggatgacatcgcagcggtgacagacatcctgacccagcgggagggcgcaaggctggagacacccccaccctggctggcaatgtttacagaccagcctgccctgcctaacccctgctcgcctgcctcagtggccccagccccagactggacccaccccctgccctgggggagaccccgaaccttttccctggatgctgtccccccagaccactcccctagggctcgctcggttgcccccctcccacctcagcgatccccacggaccagaggcctctgcagcaaaggcactctggttagtgcagggaggtagggcagagttggttccagttttcttccaggaagggtttagggaggtcccagcgagccac

SEQ ID NO: 354913 - DNA, 3040 bp, Homo sapiens
gggacagctcggaggagctggggcggagccgcagggcctggcggccgccgagtgaagtgtgactccgtgggcctggcgtggaggcgggggcgctaggctgcagctggctcggaatcggggctggtttcctgtctggaagggaaggggcctgcagaagggagcggggacagcagcagacaggcacacccctgccttcctctctccctctcctcccttctctggaaaagcgagctgggagaacagctgccaccaaagcgagactggacactctgtgcctagagccccctctgcagctggcctttcctcctgggaccccacttatcctcacttcgctttctttttcttccctgcctggctcccggcagggccccggagcagcagtgggcgaggaaaatttgtcacagcagccagaggggtttaacaggagtgcagagggataagggcagcttctgccctctgcccaagagctggccacctctttaaagactgagggaacagtgggaggaggaactgtgggacagtgtggtacctatctgtcccccctctggaggggttgacaagggaaagggcaccggggggcacagagatgcaggacagattgcacatcctggaggacctgaatatgctctacattcggcagatggcactcagcctggaggacacggagttgcagaggaagctagaccatgagatccggatgagggaaggggcctgtaagctgctggcagcctgctcccagcgagagcaggctctggaggccaccaagagcctgctagtgtgcaacagccgcatcctcagctacatgggcgagctgcagcggcgcaaggaggcgcaggtgctggggaagacaagccggcggccttctgacagtggcccgcccgctgagcgctccccctgccgcggccgggtctgcatctctgacctccggattccactcatgtggaaggacacagaatatttcaagaacaaaggtgacttgcaccgctgggctgtgttcctgctgctgcagctgggggaacacatccaggacacagagatgatcctagtggacaggaccctcacagacatctcctttcagagcaatgtgctcttcgctgaggcggggccagactttgaactgcggttagagctgtatggggcctgtgtggaagaagagggggccctgactggcggccccaagaggcttgccaccaaactcagcagctccctgggccgctcctcagggaggcgtgtccgggcatcgctggacagtgctgggggttcagggagcagtcccatcttgctccccaccccagttgttggtggtcctcgttaccacctcttggctcacaccacactcaccctggcagcagtgcaagatggattccgcacacatgacctcacccttgccagtcatgaggagaaccctgcctggctgcccctttatggtagcgtgtgttgccgtctggcagctcagcctctctgcatgactcagcccactgcaagtggtaccctcagggtgcagcaagctggggagatgcagaactgggcacaagtgcatggagttctgaaaggcacaaacctcttctgttaccggcaacctgaggatgcagacactggggaagagccgctgcttactattgctgtcaacaaggtgatgggtcccttggtagtaaggccaccaagggcacaggcccaggagcctctccttcaggccccaggagggtgggcacatacctcagagagatagaagcaggcctcctgctcctgacagtgccacatccagcttcaggggcccgtattttccccaactacagcatcactgtgagaggatcgtcccattcacttgccatcctcagtccctgccaaatctcagagagggttctctcgcctgcaggttcagggcttttcatcctctctccctcttctccctcagattccaatttatatctactttaccacttcccatttctctccaggtccaattgcccttctttgctccctatcccttttatgggctttcctgcctactttttgtcagttctgagggacctctggctggagcatccttgcctacctttgtgtcttccctgccttgctcaatccctttttccctgtctcaagctgctcctcctcccctgactcaggactggctgtctcatccccagcccttttttgccattccttcctactctggtcagtaggaggcaaatgagagggctcagcaaaagccccacaagctcattcttctaaggcaggcgtgatcaaggctgcctgattgtcactgccaacttctgtgaccaaggtagacctcttctttctcctgcaggagactcgagtccgggcaggggagctggaccaggctctaggacggcccttcaccctaagcatcagtaaccagtatggggatgatgaggtgacacacacccttcagacagaaagtcgggaagcactgcagagctggatggaggctctgtggcagcttttctttgacatgatcccttgggaagcatgaactgctttccttgaatttcttcatggagtcccatcccccaataacattaggagggggtgcataattgcctcactggatggatgataaaactgaggccacagtgtcgtgaccttctggaggtctcgtagtgaaccagtcacagtcatgactagaccctgggcccctgcacccccaacaccaggcagccaacacaacctatgggcctagccctatgccaggtacaatggagaatatgaataagaaaatatacaccctgttctcaagaggtttgcaaattacttggggagacaagagttgtcttttgagggcagtgccaattcaggtttcagctaagagacatcagtgggagctagaatatggggaaggcttcctggagaggatggatggcactggagctgggcctgaataggtgggacttgccctagagaaggaagctgcacatttcagagctggaaagtatcttagaaaccatttgttccaactcctcatttcacatcagtattataaagtcttaattaactataaaatactacataaatgtaaagt

SEQ ID NO: 354914 - DNA, 2409 bp, Homo sapiens
gggacagctcggaggagctggggcggagccgcagggcctggcggccgccgagtgaagtgtgactccgtgggcctggcgtggaggcgggggcgctaggctgcagctggctcggaatcggggctggtttcctgtctggaagggaaggggcctgcagaagggagcggggacagcagcagacaggcacacccctgccttcctctctccctctcctcccttctctggaaaagcgagctgggagaacagctgccaccaaagcgagactggacactctgtgcctagagccccctctgcagctggcctttcctcctgggaccccacttatcctcacttcgctttctttttcttccctgcctggctcccggcagggccccggagcagcagtgggcgaggaaaatttgtcacagcagccagaggggtttaacaggagtgcagagggataagggcagcttctgccctctgcccaagagctggccacctctttaaagactgagggaacagtgggaggaggaactgtgggacagtgtggtacctatctgtcccccctctggaggggttgacaagggaaagggcaccggggggcacagagatgcaggacagattgcacatcctggaggacctgaatatgctctacattcggcagatggcactcagcctggaggacacggagttgcagaggaagctagaccatgagatccggatgagggaaggggcctgtaagctgctggcagcctgctcccagcgagagcaggctctggaggccaccaagagcctgctagtgtgcaacagccgcatcctcagctacatgggcgagctgcagcggcgcaaggaggcgcaggtgctggggaagacaagccggcggccttctgacagtggcccgcccgctgagcgctccccctgccgcggccgggtctgcatctctgacctccggattccactcatgtggaaggacacagaatatttcaagaacaaaggtgacttgcaccgctgggctgtgttcctgctgctgcagctgggggaacacatccaggacacagagatgatcctagtggacaggaccctcacagacatctcctttcagagcaatgtgctcttcgctgaggcggggccagactttgaactgcggttagagctgtatggggcctgtgtggaagaagagggggccctgactggcggccccaagaggcttgccaccaaactcagcagctccctgggccgctcctcagggaggcgtgtccgggcatcgctggacagtgctgggggttcagggagcagtcccatcttgctccccaccccagttgttggtggtcctcgttaccacctcttggctcacaccacactcaccctggcagcagtgcaagatggattccgcacacatgacctcacccttgccagtcatgaggagaaccctgcctggctgcccctttatggtagcgtgtgttgccgtctggcagctcagcctctctgcatgactcagcccactgcaagtggtaccctcagggtgcagcaagctggggagatgcagaactgggcacaagtgcatggagttctgaaaggcacaaacctcttctgttaccggcaacctgaggatgcagacactggggaagagccgctgcttactattgctgtcaacaaggagactcgagtccgggcaggggagctggaccaggctctaggacggcccttcaccctaagcatcagtaaccagtatggggatgatgaggtgacacacacccttcagacagaaagtcgggaagcactgcagagctggatggaggctctgtggcagcttttctttgacatgagccaatggaagcagtgctgtgatgaaatcatgaaaattgaaactcctgctccccggaaaccaccccaagcactggcaaagcaggggtccttgtaccatgagatggctattgagccgctggatgacatcgcagcggtgacagacatcctgacccagcgggagggcgcaaggctggagacacccccaccctggctggcaatgtttacagaccagcctgccctgcctaacccctgctcgcctgcaagcccctcttaaattgtggttgccatggtaccgagggactcattcctggggctcgctgggacctccctaaacccttcctggaagaaaactggaaccaactctgccctacctccctgcactaaccagctttgaggatggcactgaagaacccttggagcaaacatacctcccttgtgactcccacatcaaccattaaagttatttaacagcagccttcacctggctcctgaggaaaaaaaacctctctctgcctggtctagacctgcctcacatcatccctggagcatagttcaccagctgtgaaacatgactgtgatactgagtaatcagacaaaggctgggtggagcgggtactttatgaatac

SEQ ID NO: 354915 - DNA, 1670 bp, Homo sapiens
gggacagctcggaggagctggggcggagccgcagggcctggcggccgccgagtgaagtgtgactccgtgggcctggcgtggaggcgggggcgctaggctgcagctggctcggaatcggggctggtttcctgtctggaagggaaggggcctgcagaagggagcggggacagcagcagacaggcacacccctgccttcctctctccctctcctcccttctctggaaaagcgagctgggagaacagctgccaccaaagcgagactggacactctgtgcctagagccccctctgcagctggcctttcctcctgggaccccacttatcctcacttcgctttctttttcttccctgcctggctcccggcagggccccggagcagcagtgggcgaggaaaatttgtcacagcagccagaggggtttaacaggagtgcagagggataagggcagcttctgccctctgcccaagagctggccacctctttaaagactgagggaacagtgggaggaggaactgtgggacagtgtggtacctatctgtcccccctctggaggggttgacaagggaaagggcaccggggggcacagagatgcaggacagattgcacatcctggaggacctgaatatgctctacattcggcagatggcactcagcctggaggacacggagttgcagaggaagctagaccatgagatccggatgagggaaggggcctgtaagctgctggcagcctgctcccagcgagagcaggctctggaggccaccaagagcctgctagtgtgcaacagccgcatcctcagctacatgggcgagctgcagcggcgcaaggaggcgcaggtgctggggaagacaagccggcggccttctgacagtggcccgcccgctgagcgctccccctgccgcggccgggtctgcatctctgacctccggattccactcatgtggaaggacacagaatatttcaagaacaaaggtgacttgcaccgctgggctgtgttcctgctgctgcagctgggggaacacatccaggacacagagatgatcctagtggacaggaccctcacagacatctcctttcagagcaatgtgctcttcgctgaggcggggccagactttgaactgcggttagagctgtatggggcctgtgtggaagaagagggggccctgactggcggccccaagaggcttgccaccaaactcagcagctccctgggccgctcctcagggaggcgtgtccgggcatcgctggacagtgctgggggttcagggagcagtcccatcttgctccccaccccagttgttgggtaaggccttgcacaccgacaccaccctcagctgcctgtattctgcccacaggtgacctttgaactgtgttgagtgtgcagaacccattttgcattgctgccaggatgtgcagacagatatgaatgagcagtggccacgtagctgggaggcattccagcccacgccccagagctgggctgaagccagtccagaagaccagtgggaaggcagggagacttaggccctggggtcttacctttttagcagcagcaaatacattttatttttagagacagggtctcactatgttgcccaggagttcgagacctgcctgggcaatatagcgagaccccgttctccagaaaaaggaaaaaaaaaaacaaaagac

SEQ ID NO: 354916 - DNA, 707 bp, Homo sapiens
aggaggaggtccccaacggagaagaccactctaaaactgtggatacccccgggagccaggaattcggcatgagtccccagaccactcccctagggctcgctcggttgcccccctcccacctcagcgatccccacggaccagaggcctctgcagcaaaggccaacctcgcacttggctccagtcaccagtgtgagagagaaaggtgctggcataggatctgcccagaagagaaaatgacccatgcgcagttgggctctggatacggcgctgtctatagcaagttggccagtctggcctcctgttcctctgctggacctggggtaggctgcaggggtgggcagaagcccctcttaaattgtggttgccatggtaccgagggactcattcctggggctcgctgggacctccctaaacccttcctggaagaaaactggaaccaactctgccctacctccctgcactaaccagctttgaggatggcactgaagaacccttggagcaaacatacctcccttgtgactcccacatcaaccattaaagttatttaacagcagccttcacctggctcctgaggaaaaaaaacctctctctgcctggtctagacctgcctcacatcatccctggagcatagttcaccagctgtgaaacatgactgtgatactgagtaatcagacaaaggctgggtggagcgggtactttatgaatac

SEQ ID NO: 354917 - DNA, 413 bp, Homo sapiens
gatccgcctgcctctgcctcccaaagtgctgggattacaggcgtgagccaccgtgcccggctgttatatatttttttagaggtggggtctcactatgttgcccaggctggccttgatctcctaggctcaagggatcctcccacctcagcctccctcacacaccactgcacctggctacaaagcttctctggttattcgtgggcagctgagattgagacccaatgcctgctcttgaactgcctaaaacattagtttcttgtcagttttactggccacagcccacctggggactggggagtgctttagcctgtccactgactgacatttccttctcacccttcccccaaccctggctaggacacggagttgcagaggaagctagaccatgagatccggatgagggaaggggcctg

SEQ ID NO: 354918 - DNA, 344 bp, Homo sapiens
gcggccgcttccgactcagcctcttcagcgacctgcccgaggtgagagactcgcgtccctgccttccccttccgcggctcccgggggcagccccagccacctcggcctccttccctcgcccgcgtgcacgccgaggggcggagacgcacggtctgggtacaaacccgacggagttgttgacttaaaaagtaaggtgtggacggtctgcattttcatcggatccatgctgcccattccgcggcctggttaggattatctgcctgagcctggaaaaagcccgggttggtctcaatttgtagggccccagctcgactcctaaaatgtgcctgaaccccaaaatgtct

SEQ ID NO: 354919 - DNA, 397 bp, Homo sapiens
gaggagccctgagcttgtgccttatgtgtgagttaatgtggcttgagtgtccctggtgtccccaagcctggcaaactgctgggttcaatgaacaactttcccttatagtccctcagccctgcctgtcggcctggctgggaacctggtggctgaggcgctgggatcagggggatcctagagtcgttgggaccagagcaagggggaatagtggctagaggccaggccaggacattgtgatttatccacaggccttctgacagtggcccgcccgctgagcgctccccctgccgcggccgggtctgcatctctggtaagaagcacagctaccccagctgctggtaccccttgcccaagcacacggcctcctgccccatctcaacatctattcttacccctc

SEQ ID NO: 354920 - DNA, 482 bp, Homo sapiens
gccaacatgcccctcccttggctgatgctctctcctatctccctcagtggtcctcgttaccacctcttggctcacaccacactcaccctggcagcagtgcaagatggattccgcacacatgacctcacccttgccagtcatggtaagtatgtgtgtgcatgggggacatacacatgtgatggtgagaagaggggctgtgggatggtccccttctcattcccctacctcaccctgcacttcctcctcccccagaggagaaccctgcctggctgcccctttatggtagcgtgtgttgccgtctggcagctcagcctctctgcatgactcagcccactgcaagtggtaccctcagggtgcaggtgagggggccctgaggagtggaagggagcagggagaaggcagaggagagctggataaccaggaatagaagagctaatgaaaaatcaagatttgggtggaagaaatggggtatggccagacga

SEQ ID NO: 354921 - DNA, 2815 bp, Homo sapiens
atcagttgtggccactaggcttaggcggatagcctcgcagaggagcctaggtggggagggggacgaagaaggaacatttgggactgtgggatgttgaaatggtctcttcggaggctgccgggattgaaactgggcaaggtcccagggcccgagtagagccagagcgtgctacgcggcgatccctgagccacggggttttcagcgcccgggaagccaggcttgccaggttggggcggctggcggggcagggcttctcggtccgtcccaagtccaggtaggcgctcgcgacccgcgcgggcagggagaacgcgctcccacagtgctcgcgaggtgcagtgcgcccctgggggctccggggccgtcgggccaggtcggcttggcgcccagggactggccggacgggctgggcctttggcgggggtggaagaggaggttgccgcgccctgcccggcccaggtgtcgtctccgggggcggggtttggagccccgcagcgggagattcccggccggactggcggacgagcgtcgagagacagaagccgaggagaggaggctaagccgggcggcgcggggagcgcactgagcaggcaaagtcgcagggccgccagcatgttctcccgaaaccaccggagccgggtcaccgtggccaggggctccgccctggagatggagttcaaacgcggccgcttccgactcagcctcttcagcgacctgcccgaggacacggagttgcagaggaagctagaccatgagatccggatgagggaaggggcctgtaagctgctggcagcctgctcccagcgagagcaggctctggaggccaccaagagcctgctagtgtgcaacagccgcatcctcagctacatgggcgagctgcagcggcgcaaggaggcgcaggtgctggggaagacaagccggcggccttctgacagtggcccgcccgctgagcgctccccctgccgcggccgggtctgcatctctgacctccggattccactcatgtggaaggacacagaatatttcaagaacaaaggtgacttgcaccgctgggctgtgttcctgctgctgcagctgggggaacacatccaggacacagagatgatcctagtggacaggaccctcacagacatctcctttcagagcaatgtgctcttcgctgaggcggggccagactttgaactgcggttagagctgtatggggcctgtgtggaagaagagggggccctgactggcggccccaagaggcttgccaccaaactcagcagctccctgggccgctcctcagggaggcgtgtccgggcatcgctggacagtgctgggggttcagggagcagtcccatcttgctccccaccccagttgttggtggtcctcgttaccacctcttggctcacaccacactcaccctggcagcagtgcaagatggattccgcacacatgacctcacccttgccagtcatgaggagaaccctgcctggctgcccctttatggtagcgtgtgttgccgtctggcagctcagcctctctgcatgactcagcccactgcaagtggtaccctcagggtgcagcaagctggggagatgcagaactgggcacaagtgcatggagttctgaaaggcacaaacctcttctgttaccggcaacctgaggatgcagacactggggaagagccgctgcttactattgctgtcaacaaggagactcgagtccgggcaggggagctggaccaggctctaggacggcccttcaccctaagcatcagtaaccagtatggggatgatgaggtgacacacacccttcagacagaaagtcgggaagcactgcagagctggatggaggctctgtggcagcttttctttgacatgagccaatggaagcagtgctgtgatgaaatcatgaaaattgaaactcctgctccccggaaaccaccccaagcactggcaaagcaggggtccttgtaccatgagatggctattgagccgctggatgacatcgcagcggtgacagacatcctgacccagcgggagggcgcaaggctggagacacccccaccctggctggcaatgtttacagaccagcctgccctgcctaacccctgctcgcctgcctcagtggccccagccccagactggacccaccccctgccctgggggagaccccgaaccttttccctggatgctgtccccccagaccactcccctagggctcgctcggttgcccccctcccacctcagcgatccccacggaccagaggcctctgcagcaaaggccaacctcgcacttggctccagtcaccagtgtgagagagaaaggtgctggcataggatctgcccagaagagaaaatgacccatgcgcagttgggctctggatacggcgctgtctatagcaagttggccagtctggcctcctgttcctctgctggacctggggtaggctgcaggggtgggcagaagcccctcttaaattgtggttgccatggtaccgagggactcattcctggggctcgctgggacctccctaaacccttcctggaagaaaactggaaccaactctgccctacctccctgcactaaccagctttgaggatggcactgaagaacccttggagcaaacatacctcccttgtgactcccacatcaaccattaaagttatttaacagcagccttcacctggctcctgaggaaaaaaaacctctctctgcctggtctagacctgcctcacatcatccctggagcatagttcaccagctgtgaaacatgactgtgatactgagtaatcagacaaaggctgggtggagcgggtactttatgaatac

SEQ ID NO: 354922 - DNA, 2753 bp, Homo sapiens
gggacagctcggaggagctggggcggagccgcagggcctggcggccgccgagtgaagtgtgactccgtgggcctggcgtggaggcgggggcgctaggctgcagctggctcggaatcggggctggtttcctgtctggaagggaaggggcctgcagaagggagcggggacagcagcagacaggcacacccctgccttcctctctccctctcctcccttctctggaaaagcgagctgggagaacagctgccaccaaagcgagactggacactctgtgcctagagccccctctgcagctggcctttcctcctgggaccccacttatcctcacttcgctttctttttcttccctgcctggctcccggcagggccccggagcagcagtgggcgaggaaaatttgtcacagcagccagaggggtttaacaggagtgcagagggataagggcagcttctgccctctgcccaagagctggccacctctttaaagactgagggaacagtgggaggaggaactgtgggacagtgtggtacctatctgtcccccctctggaggggttgacaagggaaagggcaccggggggcacagagatgcaggacagattgcacatcctggaggacctgaatatgctctacattcggcagatggcactcagcctggaggacacggagttgcagaggaagctagaccatgagatccggatgagggaaggggcctgtaagctgctggcagcctgctcccagcgagagcaggctctggaggccaccaagagcctgctagtgtgcaacagccgcatcctcagctacatgggcgagctgcagcggcgcaaggaggcgcaggtgctggggaagacaagccggcggccttctgacagtggcccgcccgctgagcgctccccctgccgcggccgggtctgcatctctgacctccggattccactcatgtggaaggacacagaatatttcaagaacaaaggtgacttgcaccgctgggctgtgttcctgctgctgcagctgggggaacacatccaggacacagagatgatcctagtggacaggaccctcacagacatctcctttcagagcaatgtgctcttcgctgaggcggggccagactttgaactgcggttagagctgtatggggcctgtgtggaagaagagggggccctgactggcggccccaagaggcttgccaccaaactcagcagctccctgggccgctcctcagggaggcgtgtccgggcatcgctggacagtgctgggggttcagggagcagtcccatcttgctccccaccccagttgttggtggtcctcgttaccacctcttggctcacaccacactcaccctggcagcagtgcaagatggattccgcacacatgacctcacccttgccagtcatgaggagaaccctgcctggctgcccctttatggtagcgtgtgttgccgtctggcagctcagcctctctgcatgactcagcccactgcaagtggtaccctcagggtgcagcaagctggggagatgcagaactgggcacaagtgcatggagttctgaaaggcacaaacctcttctgttaccggcaacctgaggatgcagacactggggaagagccgctgcttactattgctgtcaacaaggagactcgagtccgggcaggggagctggaccaggctctaggacggcccttcaccctaagcatcagtaaccagtatggggatgatgaggtgacacacacccttcagacagaaagtcgggaagcactgcagagctggatggaggctctgtggcagcttttctttgacatgagccaatggaagcagtgctgtgatgaaatcatgaaaattgaaactcctgctccccggaaaccaccccaagcactggcaaagcaggggtccttgtaccatgagatggctattgagccgctggatgacatcgcagcggtgacagacatcctgacccagcgggagggcgcaaggctggagacacccccaccctggctggcaatgtttacagaccagcctgccctgcctaacccctgctcgcctgcctcagtggccccagccccagactggacccaccccctgccctgggggagaccccgaaccttttccctggatgctgtccccccagaccactcccctagggctcgctcggttgcccccctcccacctcagcgatccccacggaccagaggcctctgcagcaaaggccaacctcgcacttggctccagtcaccagtgtgagagagaaaggtgctggcataggatctgcccagaagagaaaatgacccatgcgcagttgggctctggatacggcgctgtctatagcaagttggccagtctggcctcctgttcctctgctggacctggggtaggctgcaggggtgggcagaagcccctcttaaattgtggttgccatggtaccgagggactcattcctggggctcgctgggacctccctaaacccttcctggaagaaaactggaaccaactctgccctacctccctgcactaaccagctttgaggatggcactgaagaacccttggagcaaacatacctcccttgtgactcccacatcaaccattaaagttatttaacagcagccttcacctggctcctgaggaaaaaaaacctctctctgcctggtctagacctgcctcacatcatccctggagcatagttcaccagctgtgaaacatgactgtgatactgagtaatcagacaaaggctgggtggagcgggtactttatgaatac

SEQ ID NO: 354923 - DNA, 3428 bp, Homo sapiens
gggacagctcggaggagctggggcggagccgcagggcctggcggccgccgagtgaagtgtgactccgtgggcctggcgtggaggcgggggcgctaggctgcagctggctcggaatcggggctggtttcctgtctggaagggaaggggcctgcagaagggagcggggacagcagcagacaggcacacccctgccttcctctctccctctcctcccttctctggaaaagcgagctgggagaacagctgccaccaaagcgagactggacactctgtgcctagagccccctctgcagctggcctttcctcctgggaccccacttatcctcacttcgctttctttttcttccctgcctggctcccggcagggccccggagcagcagtgggcgaggaaaatttgtcacagcagccagaggggtttaacaggagtgcagagggataagggcagcttctgccctctgcccaagagctggccacctctttaaagactgagggaacagtgggaggaggaactgtgggacagtgtggtacctatctgtcccccctctggaggggttgacaagggaaagggcaccggggggcacagagatgcaggacagattgcacatcctggaggacctgaatatgctctacattcggcagatggcactcagcctggaggacacggagttgcagaggaagctagaccatgagatccggatgagggaaggggcctgtaagctgctggcagcctgctcccagcgagagcaggctctggaggccaccaagagcctgctagtgtgcaacagccgcatcctcagctacatgggcgagctgcagcggcgcaaggaggcgcaggtgctggggaagacaagccggcggccttctgacagtggcccgcccgctgagcgctccccctgccgcggccgggtctgcatctctgacctccggattccactcatgtggaaggacacagaatatttcaagaacaaaggtgacttgcaccgctgggctgtgttcctgctgctgcagctgggggaacacatccaggacacagagatgatcctagtggacaggaccctcacagacatctcctttcagagcaatgtgctcttcgctgaggcggggccagactttgaactgcggttagagctgtatggggcctgtgtggaagaagagggggccctgactggcggccccaagaggcttgccaccaaactcagcagctccctgggccgctcctcagggaggcgtgtccgggcatcgctggacagtgctgggggttcagggagcagtcccatcttgctccccaccccagttgttggtggtcctcgttaccacctcttggctcacaccacactcaccctggcagcagtgcaagatggattccgcacacatgacctcacccttgccagtcatgaggagaaccctgcctggctgcccctttatggtagcgtgtgttgccgtctggcagctcagcctctctgcatgactcagcccactgcaagtggtaccctcagggtgcagcaagctggggagatgcagaactgggcacaagtgcatggagttctgaaaggcacaaacctcttctgttaccggcaacctgaggatgcagacactggggaagagccgctgcttactattgctgtcaacaaggtgatgggtcccttggtagtaaggccaccaagggcacaggcccaggagcctctccttcaggccccaggagggtgggcacatacctcagagagatagaagcaggcctcctgctcctgacagtgccacatccagcttcaggggcccgtattttccccaactacagcatcactgtgagaggatcgtcccattcacttgccatcctcagtccctgccaaatctcagagagggttctctcgcctgcaggttcagggcttttcatcctctctccctcttctccctcagattccaatttatatctactttaccacttcccatttctctccaggtccaattgcccttctttgctccctatcccttttatgggctttcctgcctactttttgtcagttctgagggacctctggctggagcatccttgcctacctttgtgtcttccctgccttgctcaatccctttttccctgtctcaagctgctcctcctcccctgactcaggactggctgtctcatccccagcccttttttgccattccttcctactctggtcagtaggaggcaaatgagagggctcagcaaaagccccacaagctcattcttctaaggcaggcgtgatcaaggctgcctgattgtcactgccaacttctgtgaccaaggtagacctcttctttctcctgcaggagactcgagtccgggcaggggagctggaccaggctctaggacggcccttcaccctaagcatcagtaaccagtatggggatgatgaggtgacacacacccttcagacagaaagtcgggaagcactgcagagctggatggaggctctgtggcagcttttctttgacatgagccaatggaagcagtgctgtgatgaaatcatgaaaattgaaactcctgctccccggaaaccaccccaagcactggcaaagcaggggtccttgtaccatgagatggctattgagccgctggatgacatcgcagcggtgacagacatcctgacccagcgggagggcgcaaggctggagacacccccaccctggctggcaatgtttacagaccagcctgccctgcctaacccctgctcgcctgcctcagtggccccagccccagactggacccaccccctgccctgggggagaccccgaaccttttccctggatgctgtccccccagaccactcccctagggctcgctcggttgcccccctcccacctcagcgatccccacggaccagaggcctctgcagcaaaggccaacctcgcacttggctccagtcaccagtgtgagagagaaaggtgctggcataggatctgcccagaagagaaaatgacccatgcgcagttgggctctggatacggcgctgtctatagcaagttggccagtctggcctcctgttcctctgctggacctggggtaggctgcaggggtgggcagaagcccctcttaaattgtggttgccatggtaccgagggactcattcctggggctcgctgggacctccctaaacccttcctggaagaaaactggaaccaactctgccctacctccctgcactaaccagctttgaggatggcactgaagaacccttggagcaaacatacctcccttgtgactcccacatcaaccattaaagttatttaacagcagccttcacctggctcctgaggaaaaaaaacctctctctgcctggtctagacctgcctcacatcatccctggagcatagttcaccagctgtgaaacatgactgtgatactgagtaatcagacaaaggctgggtggagcgggtactttatgaatac

SEQ ID NO: 354924 - DNA, 2672 bp, Homo sapiens
gggacagctcggaggagctggggcggagccgcagggcctggcggccgccgagtgaagtgtgactccgtgggcctggcgtggaggcgggggcgctaggctgcagctggctcggaatcggggctggtttcctgtctggaagggaaggggcctgcagaagggagcggggacagcagcagacaggcacacccctgccttcctctctccctctcctcccttctctggaaaagcgagctgggagaacagctgccaccaaagcgagactggacactctgtgcctagagccccctctgcagctggcctttcctcctgggaccccacttatcctcacttcgctttctttttcttccctgcctggctcccggcagggccccggagcagcagtgggcgaggaaaatttgtcacagcagccagaggggtttaacaggagtgcagagggataagggcagcttctgccctctgcccaagagctggccacctctttaaagactgagggaacagtgggaggaggaactgtgggacagtgtggtacctatctgtcccccctctggaggggttgacaagggaaagggcaccggggggcacagagatgcaggacagattgcacatcctggaggacctgaatatgctctacattcggcagatggcactcagcctggaggacacggagttgcagaggaagctagaccatgagatccggatgagggaaggggcctgtaagctgctggcagcctgctcccagcgagagcaggctctggaggccaccaagagcctgctagtgtgcaacagccgcatcctcagctacatgggcgagctgcagcggcgcaaggaggcgcaggtgctggggaagacaagccggcggccttctgacagtggcccgcccgctgagcgctccccctgccgcggccgggtctgcatctctgacctccggattccactcatgtggaaggacacagaatatttcaagaacaaaggtgacttgcaccgctgggctgtgttcctgctgctgcagctgggggaacacatccaggacacagagatgatcctagtggacaggaccctcacagacatctcctttcagagcaatgtgctcttcgctgaggcggggccagactttgaactgcggttagagctgtatggggcctgtgtggaagaagagggggccctgactggcggccccaagaggcttgccaccaaactcagcagctccctgggccgctcctcagggaggcgtgtccgggcatcgctggacagtgctgggggttcagggagcagtcccatcttgctccccaccccagttgttggtggtcctcgttaccacctcttggctcacaccacactcaccctggcagcagtgcaagatggattccgcacacatgacctcacccttgccagtcatgaggagaaccctgcctggctgcccctttatggtagcgtgtgttgccgtctggcagctcagcctctctgcatgactcagcccactgcaagtggtaccctcagggtgcaggatgcagacactggggaagagccgctgcttactattgctgtcaacaaggagactcgagtccgggcaggggagctggaccaggctctaggacggcccttcaccctaagcatcagtaaccagtatggggatgatgaggtgacacacacccttcagacagaaagtcgggaagcactgcagagctggatggaggctctgtggcagcttttctttgacatgagccaatggaagcagtgctgtgatgaaatcatgaaaattgaaactcctgctccccggaaaccaccccaagcactggcaaagcaggggtccttgtaccatgagatggctattgagccgctggatgacatcgcagcggtgacagacatcctgacccagcgggagggcgcaaggctggagacacccccaccctggctggcaatgtttacagaccagcctgccctgcctaacccctgctcgcctgcctcagtggccccagccccagactggacccaccccctgccctgggggagaccccgaaccttttccctggatgctgtccccccagaccactcccctagggctcgctcggttgcccccctcccacctcagcgatccccacggaccagaggcctctgcagcaaaggccaacctcgcacttggctccagtcaccagtgtgagagagaaaggtgctggcataggatctgcccagaagagaaaatgacccatgcgcagttgggctctggatacggcgctgtctatagcaagttggccagtctggcctcctgttcctctgctggacctggggtaggctgcaggggtgggcagaagcccctcttaaattgtggttgccatggtaccgagggactcattcctggggctcgctgggacctccctaaacccttcctggaagaaaactggaaccaactctgccctacctccctgcactaaccagctttgaggatggcactgaagaacccttggagcaaacatacctcccttgtgactcccacatcaaccattaaagttatttaacagcagccttcacctggctcctgaggaaaaaaaacctctctctgcctggtctagacctgcctcacatcatccctggagcatagttcaccagctgtgaaacatgactgtgatactgagtaatcagacaaaggctgggtggagcgggtactttatgaatac

SEQ ID NO: 354925 - DNA, 2666 bp, Homo sapiens
gggacagctcggaggagctggggcggagccgcagggcctggcggccgccgagtgaagtgtgactccgtgggcctggcgtggaggcgggggcgctaggctgcagctggctcggaatcggggctggtttcctgtctggaagggaaggggcctgcagaagggagcggggacagcagcagacaggcacacccctgccttcctctctccctctcctcccttctctggaaaagcgagctgggagaacagctgccaccaaagcgagactggacactctgtgcctagagccccctctgcagctggcctttcctcctgggaccccacttatcctcacttcgctttctttttcttccctgcctggctcccggcagggccccggagcagcagtgggcgaggaaaatttgtcacagcagccagaggggtttaacaggagtgcagagggataagggcagcttctgccctctgcccaagagctggccacctctttaaagactgagggaacagtgggaggaggaactgtgggacagtgtggtacctatctgtcccccctctggaggggttgacaagggaaagggcaccggggggcacagagatgcaggacagattgcacatcctggaggacctgaatatgctctacattcggcagatggcactcagcctggaggacacggagttgcagaggaagctagaccatgagatccggatgagggaaggggcctgtaagctgctggcagcctgctcccagcgagagcaggctctggaggccaccaagagcctgctagtgtgcaacagccgcatcctcagctacatgggcgagctgcagcggcgcaaggaggcgcaggtgctggggaagacaagccggcggccttctgacagtggcccgcccgctgagcgctccccctgccgcggccgggtctgcatctctgacctccggattccactcatgtggaaggacacagaatatttcaagaacaaaggtgacttgcaccgctgggctgtgttcctgctgctgcagctgggggaacacatccaggacacagagatgatcctagtggacaggaccctcacagacatctcctttcagagcaatgtgctcttcgctgaggcggggccagactttgaactgcggttagagctgtatggggcctgtgtggaagaagagggggccctgactggcggccccaagaggcttgccaccaaactcagcagctccctgggccgctcctcagggaggcgtgtccgggcatcgctggacagtgctgggggttcagggagcagtcccatcttgctccccaccccagttgttggtggtcctcgttaccacctcttggctcacaccacactcaccctggcagcagtgcaagatggattccgcacacatgacctcacccttgccagtcatgaggagaaccctgcctggctgcccctttatggtagcgtgtgttgccgtctggcagctcagcctctctgcatgactcagcccactgcaagtggtaccctcagggtgcagcaagctggggagatgcagaactgggcacaagtgcatggagttctgaaaggcacaaacctcttctgttaccggcaacctgaggatgcagacactggggaagagccgctgcttactattgctgtcaacaaggagactcgagtccgggcaggggagctggaccaggctctaggacggcccttcaccctaagcatcagtaaccagtatggggatgatgaggtgacacacacccttcagacagaaagtcgggaagcactgcagagctggatggaggctctgtggcagcttttctttgacatgagccaatggaagcagtgctgtgatgaaatcatgaaaattgaaactcctgctccccggaaaccaccccaagcactggcaaagcaggggtccttgtaccatgagatggctattgagccgctggatgacatcgcagcggtgacagacatcctgacccagcgggagggcgcaaggctggagacacccccaccctggctggcaatgtttacagaccagcctgccctgcctaacccctgctcgcctgcctcagtggccccagccccagactggacccaccccctgccctgggggagaccccgaaccttttccctggatgctgtccccccagaccactcccctagggctcgctcggttgcccccctcccacctcagcgatccccacggaccagaggcctctgcagcaaaggccaacctcgcacttggctccagtcaccagtgtgagagagaaaggtgctggcataggatctgcccagaagagaaaatgacccatgcgcagttgggctctggatacggcgctgtctatagcaagttggccagtctggcctcctgttcctctgctggacctggggtaggctgcaggggtgggcagaagcccctcttaaattgtggttgccatggtaccgagggactcattcctggggctcgctgggacctccctaaacccttcctggaagaaaactggaaccaactctgccctacctccctgcactaaccagctttgaggatggcactgaagaacccttggagcaaacatacctcccttgtgactcccacatcaaccattaaagttatttaactttgtacagcccaacaatagacataaaaacaaaaacaccgagactagttctctctctccctcgtgccggaa

SEQ ID NO: 354926 - DNA, 2294 bp, Homo sapiens
acctcaccctgcacttcctcctcccccagaggagaaccctgcctggctgcccctttatggtagcgtgtgttgccgtctggcagctcagcctctctgcatgactcagcccactgcaagtggtaccctcagggtgcaggtgagggggccctgaggagtggaagggagcagggagaaggcagaggagagctggataaccaggaatagaagagctaatgaaaaatcaagatttgggtggaagaaatggggtatggccagacgaggggaggaatggacagcagggtggacaaaacgaacaggttctcatggggggctgagaagagggatactgggggccgtgacttccccagaaaatgttgagtcatttgtgcagcaagctggggagatgcagaactgggcacaagtgcatggagttctgaaaggcacaaacctcttctgttaccggcaacctgaggatgcagacactggggaagagccgctgcttactattgctgtcaacaaggtgatgggtcccttggtagtaaggccaccaagggcacaggcccaggagcctctccttcaggccccaggagggtgggcacatacctcagagagatagaagcaggcctcctgctcctgacagtgccacatccagcttcaggggcccgtattttccccaactacagcatcactgtgagaggatcgtcccattcacttgccatcctcagtccctgccaaatctcagagagggttctctcgcctgcaggttcagggcttttcatcctctctccctcttctccctcagattccaatttatatctactttaccacttcccatttctctccaggtccaattgcccttctttgctccctatcccttttatgggctttcctgcctactttttgtcagttctgagggacctctggctggagcatccttgcctacctttgtgtcttccctgccttgctcaatccctttttccctgtctcaagctgctcctcctcccctgactcaggactggctgtctcatccccagcccttttttgccattccttcctactctggtcagtaggaggcaaatgagagggctcagcaaaagccccacaagctcattcttctaaggcaggcgtgatcaaggctgcctgattgtcactgccaacttctgtgaccaaggtagacctcttctttctcctgcaggagactcgagtccgggcaggggagctggaccaggctctaggacggcccttcaccctaagcatcagtaaccagtatggggatgatgaggtgacacacacccttcagacagaaagtcgggaagcactgcagagctggatggaggctctgtggcagcttttctttgacatgagccaatggaagcagtgctgtgatgaaatcatgaaaattgaaactcctgctccccggaaaccaccccaagcactggcaaagcaggggtccttgtaccatgagatggctattgagccgctggatgacatcgcagcggtgacagacatcctgacccagcgggagggcgcaaggctggagacacccccaccctggctggcaatgtttacagaccagcctgccctgcctaacccctgctcgcctgcctcagtggccccagccccagactggacccaccccctgccctgggggagaccccgaaccttttccctggatgctgtccccccagaccactcccctagggctcgctcggttgcccccctcccacctcagcgatccccacggaccagaggcctctgcagcaaaggccaacctcgcacttggctccagtcaccagtgtgagagagaaaggtgctggcataggatctgcccagaagagaaaatgacccatgcgcagttgggctctggatacggcgctgtctatagcaagttggccagtctggcctcctgttcctctgctggacctggggtaggctgcaggggtgggcagaagcccctcttaaattgtggttgccatggtaccgagggactcattcctggggctcgctgggacctccctaaacccttcctggaagaaaactggaaccaactctgccctacctccctgcactaaccagctttgaggatggcactgaagaacccttggagcaaacatacctcccttgtgactcccacatcaaccattaaagttatttaacagcagccttcacctggctcctgaggaaaaaaaacctctctctgcctggtctagacctgcctcacatcatccctggagcatagttcaccagctgtgaaacatgactgtgatactgagtaatcagacaaaggctgggtggagcgggtactttatgaatac

SEQ ID NO: 354927 - DNA, 2804 bp, Homo sapiens
gggacagctcggaggagctggggcggagccgcagggcctggcggccgccgagtgaagtgtgactccgtgggcctggcgtggaggcgggggcgctaggctgcagctggctcggaatcggggctggtttcctgtctggaagggaaggggcctgcagaagggagcggggacagcagcagacaggcacacccctgccttcctctctccctctcctcccttctctggaaaagcgagctgggagaacagctgccaccaaagcgagactggacactctgtgcctagagccccctctgcagctggcctttcctcctgggaccccacttatcctcacttcgctttctttttcttccctgcctggctcccggcagggccccggagcagcagtgggcgaggaaaatttgtcacagcagccagaggggtttaacaggagtgcagagggataagggcagcttctgccctctgcccaagagctggccacctctttaaagactgagggaacagtgggaggaggaactgtgggacagtgtggtacctatctgtcccccctctggaggggttgacaagggaaagggcaccggggggcacagagatgcaggacagattgcacatcctggaggacctgaatatgctctacattcggcagatggcactcagcctggaggacacggagttgcagaggaagctagaccatgagatccggatgagggaaggggcctgtaagctgctggcagcctgctcccagcgagagcaggctctggaggccaccaagagcctgctagtgtgcaacagccgcatcctcagctacatgggcgagctgcagcggcgcaaggaggcgcaggtgctggggaagacaagccggcggccttctgacagtggcccgcccgctgagcgctccccctgccgcggccgggtctgcatctctgacctccggattccactcatgtggaaggacacagaatatttcaagaacaaaggtgacttgcaccgctgggctgtgttcctgctgctgcagctgggggaacacatccaggacacagagatgatcctagtggacaggaccctcacagacatctcctttcagagcaatgtgctcttcgctgaggcggggccagactttgaactgcggttagagctgtatggggcctgtgtggaagaagagggggccctgactggcggccccaagaggcttgccaccaaactcagcagctccctgggccgctcctcagggaggcgtgtccgggcatcgctggacagtgctgggggttcagggagcagtcccatcttgctccccaccccagttgttggtggtcctcgttaccacctcttggctcacaccacactcaccctggcagcagtgcaagatggattccgcacacatgacctcacccttgccagtcatgaggagaaccctgcctggctgcccctttatggtagcgtgtgttgccgtctggcagctcagcctctctgcatgactcagcccactgcaagtggtaccctcagggtgcagcaagctggggagatgcagaactgggcacaagtgcatggagttctgaaaggcacaaacctcttctgttaccggcaacctgaggatgcagacactggggaagagccgctgcttactattgctgtcaacaaggtgatgggtcccttggtagtaaggccaccaagggcacaggcccaggagcctctccttcaggccccaggagggtgggcacatacctcagagagatagaagcaggcctcctgctcctgacagtgccacatccagcttcaggggcccgtattttccccaactacagcatcactgtgagaggatcgtcccattcacttgccatcctcagtccctgccaaatctcagagagggttctctcgcctgcaggttcagggcttttcatcctctctccctcttctccctcagattccaatttatatctactttaccacttcccatttctctccaggtccaattgcccttctttgctccctatcccttttatgggctttcctgcctactttttgtcagttctgagggacctctggctggagcatccttgcctacctttgtgtcttccctgccttgctcaatccctttttccctgtctcaagctgctcctcctcccctgactcaggactggctgtctcatccccagcccttttttgccattccttcctactctggtcagtaggaggcaaatgagagggctcagcaaaagccccacaagctcattcttctaaggcaggcgtgatcaaggctgcctgattgtcactgccaacttctgtgaccaaggtagacctcttctttctcctgcaggagactcgagtccgggcaggggagctggaccaggctctaggacggcccttcaccctaagcatcagtaaccagtatggggatgatgaggtgacacacacccttcagacagaaagtcgggaagcactgcagagctggatggaggctctgtggcagcttttctttgacatgagccaatggaagcagtgctgtgatgaaatcatgaaaattgaaactcctgctccccggaaaccaccccaagcactggcaaagcaggggtccttgtaccatgagatgggtaagtgagaggaatgtgaactccaggaagctaatgggaagtagggttggggacttcaagagaaaccagataatggaaacagagagaaagcacactctgggctacaccagatctctggggacccaagtctcacccaatcttgtgtgttcttttctcctctccaactctttttagaaccacctccaccaaagttcaaaacaaaaccccagtgagccaggatca

SEQ ID NO: 354928 - DNA, 1005 bp, Homo sapiens
ggcccaggtgaggggctgctcctgcaggataacgcaatctccactgagatccaggctttgctttcctcctattacagtgacaggtgatagggctgggtaggcttggggcctgagctctgactagcccaaccctcccccaaccccttcctggtgccacagctattgagccgctggatgacatcgcagcggtgacagacatcctgacccagcgggagggcgcaaggctggagacacccccaccctggctggcaatgtttacagaccagcctgccctgcctaacccctgctcgcctgcctcagtggccccagccccagactggacccaccccctgccctgggggagaccccgaaccttttccctggatgctgtccccccagaccactcccctagggctcgctcggttgcccccctcccacctcagcgatccccacggaccagaggcctctgcagcaaaggccaacctcgcacttggctccagtcaccagtgtgagagagaaaggtgctggcataggatctgcccagaagagaaaatgacccatgcgcagttgggctctggatacggcgctgtctatagcaagttggccagtctggcctcctgttcctctgctggacctggggtaggctgcaggggtgggcagaagcccctcttaaattgtggttgccatggtaccgagggactcattcctggggctcgctgggacctccctaaacccttcctggaagaaaactggaaccaactctgccctacctccctgcactaaccagctttgaggatggcactgaagaacccttggagcaaacatacctcccttgtgactcccacatcaaccattaaagttatttaacagcagccttcacctggctcctgaggaaaaaaaacctctctctgcctggtctagacctgcctcacatcatccctggagcatagttcaccagctgtgaaacatgactgtgatactgagtaatcagacaaaggctgggtggagcgggtactttatgaatac

SEQ ID NO: 354929 - DNA, 757 bp, Homo sapiens
  misc_feature (732)..(732): n is a, c, g, or t
  misc_feature (751)..(751): n is a, c, g, or t
tcccaacatgctgggattatgggtgtgagccaccgcacctggccatgtagaccttcttaaaccaacttactcaaaagtagccactcttttggatgaagctacagggtttccatatgtttaaacaaagctcttagtttacatctgtgtccttagccacattttattgcagcatcaataaaactccttagtcccatgttttgattaacttggatgaaattcaaggagtaaagctagaaatagctcacacttatattttataaggtaagtggtttaggttttaaattagcctccactgatctctgttccagagaagttctcaagcattatgggtgaaataaatagggaaaataatgttcatgaaatactcagaacatagtccccttcgaaggaataaagtccccttcaaatttcgtcaccctagaagatcgtgtgtttagcagtgctgccatttgttcaaaacatttttaggattcctcttttgaatctgtatcccatttttgatcaccacagttgcaccaaatctttacattttaaggggtagatttgagcccaggcatgaaatattggaggtagcaggaggcaggagacctggtgcttggtcctgtttttctgcagactttgtggcctttggtgggccacccagcttttttggcccttcattttctcatatggggctcaatgagataatctgaaggtggcttttacaagtgcatatctagttcattgcactgnaatttcactgattagctantcatgt

SEQ ID NO: 354930 - DNA, 5634 bp, Homo sapiens
cccgcgcgtgcgtgctgtgccaaggctgcaaggcgctgaggggagaggcgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacatcgggaggagtgcacttgtgacctcctcttcatctctgccttccttcccctccacactttcctggtcgagggacgaaagcgcccgaagggcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgtttttgtggtaaaaaaaaac

SEQ ID NO: 354931 - DNA, 4755 bp, Homo sapiens
cccgcgcgtgcgtgctgtgccaaggctgcaaggcgctgaggggagaggcgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacatcgggaggagtgcacttgtgacctcctcttcatctctgccttccttcccctccacactttcctggtcgagggacgaaagcgcccgaagggcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgtttttgtggtaaaaaaaaac

SEQ ID NO: 354932 - DNA, 5708 bp, Homo sapiens
cccgcgcgtgcgtgctgtgccaaggctgcaaggcgctgaggggagaggcgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccgggtgagtcgcaccggccgggcccgctcccctctgctttcctggcccggacccctaccccggggccgccccctcagatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacatcgggaggagtgcacttgtgacctcctcttcatctctgccttccttcccctccacactttcctggtcgagggacgaaagcgcccgaagggcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgtttttgtggtaaaaaaaaac

SEQ ID NO: 354933 - DNA, 5032 bp, Homo sapiens
tttttaacctgtgacacattttatgtcagcaccacaagtgctgacaaaccaaggtttacaagtccctgcatcttgaatcagaattgtaacaccttgtggcattggagctatgcaagcagctgttaacctaaagctgttcacttgtacgggttggttaaacctcacctactggtgtataatttatggtctcaatagcagtgcatgattcaggtaagcctcttttagagtagtcaggcagtaagtattaagcacctcctccatacacagcgtttgggtaagtcaatgaaagggtcctaaggacttagctggcacagcccctgctcccaaaggcactgtcaattaaaaaatactttcatgcataaagagtggtacatgaccacaacctgggaaagccgtggaaagggcataggctttgaaatccacgtcccagttctggctccatctcttttttaatggaagggtaatgtaaggtaagaggaggaaggtggctgtgggtaagggaccacctttacaggcaaggtggggtttgcactgggcctttgccattccctccacacctaggaattatggagagcctttctttcctagttccagtggcatatggattaccaaggccctttcaggattcgtttttttattttttattttttagagacagagtctcatgttgcccagtctgtagtacaatagctatttacaggcatggtcatagcgtactgcagcctcaaactctcctgggctcaagcagtcctccctcagcctcctgaggagctgggactacaggttcatgctaccatgcctggctgatttatttatttatttatttatttatttatttatttatttatttattttatttattttttaaatgttgcccaggctggtctcaaactcctagccttaagcaatcgtcctgcctcagcctcccaaaatacagggattacaggtgtgagccaccacaccctgcctgtattttaactgcatctcattatgttataaatttgagaactaaatgaggatatgttgccttgcatgtctgttagtttgtactaaggatctgattaggaagtggccactgagctaagaagaaaatggtgcaaagaaggaaagaggccatttctggatccaatattcatcttttactaaattttcactagagagttgtcccctgtcccaaatgagatttgggatgtgaaggccagtagcctaacaggtaacaattcctggggaagactcctgagaagagtctcatgttacaaactcatgagggtccctcttctttcttgtaggcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgtttttgtggtaaaaaaaaac

SEQ ID NO: 354934 - DNA, 4984 bp, Homo sapiens
  misc_feature (96)..(96): n is a, c, g, or t
gtagagctccctggacactgaacctctaaagggaaaaggtctaccctggagccaggagcatcagggttggcttgggagcatgagaggtgagcccanggctaggcctgggccaggccccggcagcactgctacttgggaggagccacttcacctttgtattagttattaaaaaatataatttcggcctcccgagcagctgggactacaggcgcactctaccacacccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacatcgggaggagtgcacttgtgacctcctcttcatctctgccttccttcccctccacactttcctggtcgagggacgaaagcgcccgaagggcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgtttttgtggtaaaaaaaaac

SEQ ID NO: 354935 - DNA, 5123 bp, Homo sapiens
agtgctggtcacgtttcagaggactgagctgagcaagtgctgggattataggcgggagccatcgagcccgacatattttcttatatcatgctttttttttaatacttcaaaaattgtgactcctcacataagggcctggaaggtaacctggcaatagcttttgtcgtttagttggtggacgatttttttttcctctttaacacttacatgattgtggtatttcagaaggagttactttcaccagattgttctgtttagagctcctcactgactctactgggctgtagaatgcttggttctaacatggtccatgaactgtaattaatatttttatctcttgggtgtcttaaactttacagagttcacaagtctggctttatttatttgcttattagctttgtatgttttcttagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacatcgggaggagtgcacttgtgacctcctcttcatctctgccttccttcccctccacactttcctggtcgagggacgaaagcgcccgaagggcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgtttttgtggtaaaaaaaaac

SEQ ID NO: 354936 - DNA, 4746 bp, Homo sapiens
cggccgccaacttttttttaattgacagcccctgctcccaaaggcactgtcaattaaaaaatactttcatgcataaagagtggtacatgaccacaacctgggaaagccgtggaaagggcataggctttgaaatccacgtcccagttctggctccatctcttttttaatggaagggtaatgtaaggtaagaggaggaaggtggctgtgggtaagggaccacctttacaggcaaggtggggtttgcactgggcctttgccattccctccacacctaggaattatggagagcctttctttcctagttccagtggcatatggattaccaaggccctttcaggattcgtttttttattttttattttttagagacagagtctcatgttgcccagtctgtagtacaatagctatttacaggcatggtcatagcgtactgcagcctcaaactctcctgggctcaagcagtcctccctcagcctcctgaggagctgggactacaggttcatgctaccatgcctggctgatttatttatttatttatttatttatttatttatttatttatttattttatttattttttaaatgttgcccaggctggtctcaaactcctagccttaagcaatcgtcctgcctcagcctcccaaaatacagggattacaggtgtgagccaccacaccctgcctgtattttaactgcatctcattatgttataaatttgagaactaaatgaggatatgttgccttgcatgtctgttagtttgtactaaggatctgattaggaagtggccactgagctaagaagaaaatggtgcaaagaaggaaagaggccatttctggatccaatattcatcttttactaaattttcactagagagttgtcccctgtcccaaatgagatttgggatgtgaaggccagtagcctaacaggtaacaattcctggggaagactcctgagaagagtctcatgttacaaactcatgagggtccctcttctttcttgtaggcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgtttttgtggtaaaaaaaaac

SEQ ID NO: 354937 - DNA, 5137 bp, Homo sapiens
tcccaacatgctgggattatgggtgtgagccaccgcacctggccatgtagaccttcttaaaccaacttactcaaaagtagccactcttttggatgaagctacagggtttccatatgtttaaacaaagctcttagtttacatctgtgtccttagccacattttattgcagcatcaataaaactccttagtcccatgttttgattaacttggatgaaattcaaggagtaaagctagaaatagctcacacttatattttataaggtaagtggtttaggttttaaattagcctccactgatctctgttccagagaagttctcaagcattatgggtgaaataaatagggaaaataatgttcatgaaatactcagaacatagtccccttcgaaggaataaagtccccttcaaatttcgtcaccctagaagatcgtgtgtttagcagtgctgccatttgttcaaaacatttttaggattcctcttttgaatctgtatcccatttttgatcaccacagttgcaccaaatctttacattttaaggggtagatttgagcccaggcatgaaatattggaggtagcaggaggcaggagacctggtgcttggtcctgtttttctgcagactttgtggcctttggtgggccacccagcttttttggcccttcattttctcatatggggctcaatgagataatctgaaggtggcttccagtgctgaaggtctgtggtcatataagtgctggcatgtttttttgtttgtttgtttctgagacagggtcttatcttactctgtttcccaggctggagtacagtggtgcgaccatggctcaatgcaaccttgaactcctgggctcaagcagtcctccctcagcctcctgaggagctgggactacaggttcatgctaccatgcctggctgatttatttatttatttatttatttatttatttatttatttatttattttatttattttttaaatgttgcccaggctggtctcaaactcctagccttaagcaatcgtcctgcctcagcctcccaaaatacagggattacaggtgtgagccaccacaccctgcctgtattttaactgcatctcattatgttataaatttgagaactaaatgaggatatgttgccttgcatgtctgttagtttgtactaaggatctgattaggaagtggccactgagctaagaagaaaatggtgcaaagaaggaaagaggccatttctggatccaatattcatcttttactaaattttcactagagagttgtcccctgtcccaaatgagatttgggatgtgaaggccagtagcctaacaggtaacaattcctggggaagactcctgagaagagtctcatgttacaaactcatgagggtccctcttctttcttgtaggcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgtttttgtggtaaaaaaaaac

SEQ ID NO: 354938 - DNA, 4379 bp, Homo sapiens
gccccaccatgacaaattttaaagtggttagacattttgttttgaggaagtccaaaccacaacttttccacattcagaaatgaagctatttaatttgcttacgtgatgaagggagttgattgtgtttcacccaatccagaagaaagggtccttgtttgtattggctttttactttcagcccggctagctgttactgtccttattgtttaaaactggtagttgtattcatttacttggtgtttgctttttctgcttgctgtaaaaaaacacagtcccactgccaaacatttctttcagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacatcgggaggagtgcacttgtgacctcctcttcatctctgccttccttcccctccacactttcctggtcgagggacgaaagcgcccgaagggcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgtttttgtggtaaaaaaaaac

SEQ ID NO: 354939 - DNA, 3780 bp, Homo sapiens
ttgttctgcatgaatgttgatttaataagacaaggatatacaagtcgtgctaaaaggcacattttaaaatttataggattttctggaatattttacccacatggattaatatttttcaaaaactacttcaaaataccacatactactaaaattaccctgcatgcactttgacctttgaatcagaatatttcagcatctcttacgctgtgggctgcaaagcttggagtgtgtgaagcacccctttgagaaagggcaggaccaaaccgcctttcactctggggagcagcttggtttgctttagaagaatgtttgtcccctgcttttggatgtctgccctgcagttcagggtaaacggctgtctttttccttttagaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgtttttgtggtaaaaaaaaac

SEQ ID NO: 354940 - DNA, 2800 bp, Homo sapiens
cccgcgcgtgcgtgctgtgccaaggctgcaaggcgctgaggggagaggcgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacatcgggaggagtgcacttgtgacctcctcttcatctctgccttccttcccctccacactttcctggtcgagggacgaaagcgcccgaagggcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcata

SEQ ID NO: 354941 - DNA, 1670 bp, Homo sapiens
ttgttctgcatgaatgttgatttaataagacaaggatatacaagtcgtgctaaaaggcacattttaaaatttataggattttctggaatattttacccacatggattaatatttttcaaaaactacttcaaaataccacatactactaaaattaccctgcatgcactttgacctttgaatcagaatatttcagcatctcttacgctgtgggctgcaaagcttggagtgtgtgaagcacccctttgagaaagggcaggaccaaaccgcctttcactctggggagcagcttggtttgctttagaagaatgtttgtcccctgcttttggatgtctgccctgcagttcagggtaaacggctgtctttttccttttagaaacccaagtctgatatggtgaggacttcccttcgtttactgacgtccagtgcctaccgactgcagtcagagtgcaagaagacctcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgtttttgtggtaaaaaaaaac

SEQ ID NO: 354942 - DNA, 2109 bp, Homo sapiens
cccgcgcgtgcgtgctgtgccaaggctgcaaggcgctgaggggagaggcgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacatcgggaggagtgcacttgtgacctcctcttcatctctgccttccttcccctccacactttcctggtcgagggacgaaagcgcccgaagggcatccaggctggagaagcagaacagcacacctgagagtgactacgacaacactcccaacgacatggagccagatggcatggggtacatgcacaggacgagcgtgccaggggaggggctccccagggccagagacctggcaggcctgggccagcagaagcagttcaccacacacaccccttttctctattttcagactcataaagtcttaaagtattc

SEQ ID NO: 354943 - DNA, 1463 bp, Homo sapiens
cccgcgcgtgcgtgctgtgccaaggctgcaaggcgctgaggggagaggcgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcatacagaatttgggtcggttaccaccacgccaagcatttcccacgcgggtcttttacattttcatgtacgcacagagaggaggacatgcaggacaagttctgcttctcggggttcatatagacattgtcgagcttatattgccaaccgtccattaccaccacagggttctcactctcgacaccgatcagcccgactatcgacagcctggcatgaaagcgctagacagctagatttggaaagcaatctgcacgctaaacaccaattcggtcagacagtgcctggtttatgatgatatatgataagtccagtctc

SEQ ID NO: 354944 - DNA, 1480 bp, Homo sapiens
tttttaacctgtgacacattttatgtcagcaccacaagtgctgacaaaccaaggtttacaagtccctgcatcttgaatcagaattgtaacaccttgtggcattggagctatgcaagcagctgttaacctaaagctgttcacttgtacgggttggttaaacctcacctactggtgtataatttatggtctcaatagcagtgcatgattcaggtaagcctcttttagagtagtcaggcagtaagtattaagcacctcctccatacacagcgtttgggtaagtcaatgaaagggtcctaaggacttagctggcacagcccctgctcccaaaggcactgtcaattaaaaaatactttcatgcataaagagtggtacatgaccacaacctgggaaagccgtggaaagggcataggctttgaaatccacgtcccagttctggctccatctcttttttaatggaagggtaatgtaaggtaagaggaggaaggtggctgtgggtaagggaccacctttacaggcaaggtggggtttgcactgggcctttgccattccctccacacctaggaattatggagagcctttctttcctagttccagtggcatatggattaccaaggccctttcaggattcgtttttttattttttattttttagagacagagtctcatgttgcccagtctgtagtacaatagctatttacaggcatggtcatagcgtactgcagcctcaaactcctgggctcaagcagtcctcccacttcaggcttctgagtagctgggcctacaggcatgcgccaccatgccctgacccttttggaattcttcacttcactttcagtctattaagaattctcagccgagtgcagtgactcacacactttgggaggcctaggcgggtggattgcttgagcccaggagttcaagaccagcctcagcaacatggcgaaatcccatctctataaaaaatataaaaaattatccgggtgtgttgatgtgcacctgtagtcccaggtgcttgggaggctgagatgggaggatcacttgagcccaccatgagagatcgaggctgcagtgagccatgattgtgccattgcactccagcctggacaacacagtgaggccctgtctcaaaaaaaaaaaaggaattactgtactaaaaaaaaaaaaaaagaattcttgatacattgtacttaaagtctcggctgggtgcagtggctcatgcctgtaatcccagcactttggaaggccaaggtgggtggatcacttgagcccaggaatttgagaccagcctggccaacatggcaaaacctgtctctactaaaaatacaaaaattagcggcgggtggtggcgcatgcctgtaatcccagatacttggaaggctgaggcacgagaatcaagaatcccttgaacctgggaagtggaggttgcagtaagccgagattgcaccactgcactccagcctgggcgacagagtgagattgt

SEQ ID NO: 354945 - DNA, 1507 bp, Homo sapiens
tttttaacctgtgacacattttatgtcagcaccacaagtgctgacaaaccaaggtttacaagtccctgcatcttgaatcagaattgtaacaccttgtggcattggagctatgcaagcagctgttaacctaaagctgttcacttgtacgggttggttaaacctcacctactggtgtataatttatggtctcaatagcagtgcatgattcaggtaagcctcttttagagtagtcaggcagtaagtattaagcacctcctccatacacagcgtttgggtaagtcaatgaaagggtcctaaggacttagctggcacagcccctgctcccaaaggcactgtcaattaaaaaatactttcatgcataaagagtggtacatgaccacaacctgggaaagccgtggaaagggcataggctttgaaatccacgtcccagttctggctccatctcttttttaatggaagggtaatgtaaggtaagaggaggaaggtggctgtgggtaagggaccacctttacaggcaaggtggggtttgcactgggcctttgccattccctccacacctaggaattatggagagcctttctttcctagttccagtggcatatggattaccaaggccctttcaggattcgtttttttattttttattttttagagacagagtctcatgttgcccagtctgtagtacaatagctatttacaggcatggtcatagcgtactgcagcctcaaactctcctgggctcaagcagtcctccctcagcctcctgaggagctgggactacaggttcatgctaccatgcctggctgatttatttatttatttatttatttatttatttatttatttatttattttatttattttttaaatgttgcccaggctggtctcaaactcctagccttaagcaatcgtcctgcctcagcctcccaaaatacagggattacaggtgtgagccaccacaccctgcctgtattttaactgcatctcattatgttataaatttgagaactaaatgaggatatgttgccttgcatgtctgttagtttgtactaaggatctgattaggaagtggccactgagctaagaagaaaatggtgcaaagaaggaaagaggccatttctggatccaatattcatcttttactaaattttcactagagagttgtcccctgtcccaaatgagatttgggatgtgaaggccagtagcctaacaggtaacaattcctggggaagactcctgagaagagtctcatgttacaaactcatgagggtccctcttctttcttgtaggcatccaggctggagaagcagaacagcacacctgagagtgactacgacaacactcccaacgacatggagccagatggcatggggtacatgcacaggacgagcgtgccaggggaggggctccccagggccagagacctggcaggcctgggccagcagaagcagttcaccacacacaccccttttctctattttcagactcataaagtcttaaagtattc

SEQ ID NO: 354946 - DNA, 982 bp, Homo sapiens
agtgctggtcacgtttcagaggactgagctgagcaagtgctgggattataggcgggagccatcgagcccgacatattttcttatatcatgctttttttttaatacttcaaaaattgtgactcctcacataagggcctggaaggtaacctggcaatagcttttgtcgtttagttggtggacgatttttttttcctctttaacacttacatgattgtggtatttcagaaggagttactttcaccagattgttctgtttagagctcctcactgactctactgggctgtagaatgcttggttctaacatggtccatgaactgtaattaatatttttatctcttgggtgtcttaaactttacagagttcacaagtctggctttatttatttgcttattagctttgtatgttttcttagcagcctggatttgtctgaattggcaaaagctgctaagaagaaacttcaatctgtgagtatttttttgtactggttttctctagtatgagaatcagtgcaccctgctgatacctactctgaatgcaggttacctattgcgtctgatgactttatttcatacttttatttgttaaactagaagcagactgttgagtatacagcagtgatgaccacaaggactattaagttcagtatattcagttcattggttctgcttcagataatctcatttttctctatcatgtaacaagtgcagatggcacctttggcattaggcagttgttctcctcaggagagttccctagttcctctcagtgtcatgagtaagtagggcacgcgttcttggggtgacttagccatgtagggttctagagctggtaaatgctgatgctgaaatggtggcgagtcccatagattcactggctgccatttggatccagccatattgtaaacctctttcccatcccatgccattcatcagtgctttttaaatttctgctgttaaaagctggtggtcttggcccatgtgc

SEQ ID NO: 354947 - DNA, 370 bp, Homo sapiens
ctcaatttgctttcttagcttgaatgaaaaagcatgcatctgaaatggtagatccacattagggctacaaactgtggccctgaaccagaaagaagataactgtttacccaaggctcccactggtgtttttagtctcaattaacattgtacctaatcagccaaggtaggtcataccatccaacaagatgaccagcctgatgcattgatgagcatactgaaacaaaaatgtctcctttttctgacaaaccaaacttcagtcatcttttgccatctggcggtatagcaacctgctggtatccctgccactgagatttcactctctttccagatccttcctgggcatcagtaaataggggaacgtttttatgtg

SEQ ID NO: 354948 - DNA, 203 bp, Homo sapiens
agtcactgtacaggaatttatggaggtcaaaaacgctctagtggcttctgaggccaagatacagcagctaatgaaggtgaataacaacttgagtgacgagctgagaattatgcagaaaaaggtaacatgttaataaatgccaggacggttgacgctttaatcccatagtacaaggaagaatctcaggcactgtgatgtggtcc

SEQ ID NO: 354949 - DNA, 2362 bp, Homo sapiens
cccgcgcgtgcgtgctgtgccaaggctgcaaggcgctgaggggagaggcgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaagttgcttggaaaagatgctaattaatgaagaggagcaactactattggtgtatttttcacagattggtgctttctaaataaaaattgaaagtaactcctaacattgaatgggtttgctactgaaaaagtaatgatcttctggtgcaaacagttgcttgtggacttaaaccttggcactggtggggaatttggtcagattttacaatctctgtcaaagagtagacagctgaactcacaccacacccagcttatagaatgtccatggaagatgaaggcgcaccagaagggaaggaccctgcgcagaatggacgtggtgaatggtgtttaaaatgccagatgccaaagagtaacacgattccctgctgaccccttaactctaatccatccagcaccatggagcagcctgcatgtgaggaatggaaggagcattcagggcctccaagtgacagtctctaaaatggggtggtgccaggcagattagcatgttcaaagctgacaccactgaggtcgtgttttttgggtgacaaagccaaaggagagaaaggccaaatattccagccctggccgaaagatgatcactcaccagacggaagcaagcgtgctgcgtggagcatccatgcgaagatgtcaattccatagatcaataggtttccagttttcttcgtgatatgttaatatagcaaacttaccatgatccggttttctcttttttctttttttttttacaaagtgctgaattgtttggaatatcaagagtattatgtaataaaaacttgttgatcataatttttcttgttggctttttggaaag

SEQ ID NO: 354950 - DNA, 5525 bp, Homo sapiens
cccgcgcgtgcgtgctgtgccaaggctgcaaggcgctgaggggagaggcgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacatcgggaggagtgcacttgtgacctcctcttcatctctgccttccttcccctccacactttcctggtcgagggacgaaagcgcccgaagggcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgtttttgtggtaaaaaaaaac

SEQ ID NO: 354951 - DNA, 5246 bp, Homo sapiens
gcggccgctcccaacatcagaatggtaattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacatcgggaggagtgcacttgtgacctcctcttcatctctgccttccttcccctccacactttcctggtcgagggacgaaagcgcccgaagggcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgtttttgtggtaaaaaaaaac

SEQ ID NO: 354952 - DNA, 5176 bp, Homo sapiens
atgcgttactgatgtaacatatattaaaatggtctatcagctgccctaggacatcattctttacacctctaaccacgattccttttttgtttctgcgtttttcagcaactccattcgagcgtgagaacagggaatcttgaaacctgtttgagactgttatctttaggagcacaagccaacttctttcatcctcacaagaaggttgatgattctcaaaagtcttgtgtgataaactgctcaggtgtctcaggagacgtctttgtactccattttaaagtcagtgaatagtgagcaatataaatggtactttgttttctcttggtaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacatcgggaggagtgcacttgtgacctcctcttcatctctgccttccttcccctccacactttcctggtcgagggacgaaagcgcccgaagggcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgtttttgtggtaaaaaaaaac

SEQ ID NO: 354953 - DNA, 3899 bp, Homo sapiens
cccgcgcgtgcgtgctgtgccaaggctgcaaggcgctgaggggagaggcgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatcttatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgtttttgtggtaaaaaaaaac

SEQ ID NO: 354954 - DNA, 2416 bp, Homo sapiens
cccgcgcgtgcgtgctgtgccaaggctgcaaggcgctgaggggagaggcgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcata

SEQ ID NO: 354955 - DNA, 1814 bp, Homo sapiens
cccgcgcgtgcgtgctgtgccaaggctgcaaggcgctgaggggagaggcgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaaggtgagaggccatgcgtcccatggaagggcaagcacgcatcagctgagggctagccctgccaaagctgctgtgcagtgaggttgggtttgttactagctcaggccaagcaaaggtgaaacaaggttaaatggttttaaaatagggatccttgtccctgcatcacagccctgctgcagttgagactttataaaacttgtgaggagtgattggtgtgttttattcattcaacaagtgtttactgagtgacttctctggatattactctcctgaatgaggcctcgtccctttcctgtgaggctctcattgcctaggagagagagaactgcggagaaggcacaaagtgatgtgtgtcatacgaagcacacacaggctgagggagtgagcagagagagaatctatggctgggagcatc

SEQ ID NO: 354956 - DNA, 1493 bp, Homo sapiens
cccgcgcgtgcgtgctgtgccaaggctgcaaggcgctgaggggagaggcgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctgtgagtatttttttgtactggttttctctagtatgagaatcagtgcaccctgctgatacctactctgaatgcaggttacctattgcgtctgatgactttatttcatacttttatttgttaaactagaagcagactgttgagtatacagcagtgatgaccacaaggactattaagttcagtatattcagttcattggttctgcttcagataatctcatttttctctatcatgtaacaagtgcagatggcacctttggcattaggcagttgttctcctcaggagagttccctagttcctctcagtgtcatgagtaagtagggcacgcgttcttggggtgacttagccatgtagggttctagagctggtaaatgctgatgctgaaatggtggcgagtcccatagattcactggctgccatttggatccagccatattgtaaacctctttcccatcccatgccattcatcagtgctttttaaatttctgctgttaaaagctggtggtcttggcccatgtgc

SEQ ID NO: 354957 - DNA, 1772 bp, Homo sapiens
cctttgtttacaaccctgccatgatctccctcttgcaaaagcgagggctacagaacaggcattcaggagtcctgtgctccagtcacagccttttctgttcttcagctaggagacaccaaaccctcaggaagatttactatagctaagagaaaactgcagcagaaagggcgcggctacctacttcttaaattccgtttgtggaccctcagactcttagtcccctactcccagatacagcggccctaccgtggctcctggcaagaagcatggatctcggaatccctgacctgctggacgcgtggctggagcccccagaggatatcttctcgacaggatccgtcctggagctgggactccactgcccccctccagaggttccggtaactaggctacaggaacagggactgcaaggctggaagtccggtggggaccgtggctgtggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttgcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttcttctttgggtatagggttgaggggaaataagttttgagtgagaaataaacgttttagctgaaattgtatcccagaagtttgaaataa

SEQ ID NO: 354958 - DNA, 1592 bp, Homo sapiens
atcctggaagaaagaaaaggtgtagtgtttggggaggtcaacgggctatgctggcttgacagggctgggctcttcagaacagaagcatggatctcggaatccctgacctgctggacgcgtggctggagcccccagaggatatcttctcgacaggatccgtcctggagctgggactccactgcccccctccagaggttccggtaactaggctacaggaacagggactgcaaggctggaagtccggtggggaccgtggctgtggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttgcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttcttctttgggtatagggttgaggggaaataagttttgagtgagaaataaacgttttagctgaaattgtatcccagaagtttgaaataa

SEQ ID NO: 354959 - DNA, 1745 bp, Homo sapiens
cctttgtttacaaccctgccatgatctccctcttgcaaaagcgagggctacagaacaggcattcaggagtcctgtgctccagtcacagccttttctgttcttcagctaggagacaccaaaccctcaggaagatttactatagctaagagaaaactgcagcagaaagggcgcggctacctacttcttaaattccgtttgtggaccctcagactcttagtcccctactcccagatacagcggccctaccgtggctcctggcaagaagcatggatctcggaatccctgacctgctggacgcgtggctggagcccccagaggatatcttctcgacaggatccgtcctggagctgggactccactgcccccctccagaggttccggtaactaggctacaggaacagggactgcaaggctggaagtccggtggggaccgtggctgtggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttgcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttctttacgttcagttagaagcggtaattaactcctcgcggacgaatattactccaacaatac

SEQ ID NO: 354960 - DNA, 1643 bp, Homo sapiens
atcctggaagaaagaaaaggtgtagtgtttggggaggtcaacgggctatgctggcttgacagggctgggctcttcagaacaggtaatgcttggggggggcctctttgtctaaacctgagggatagggctgaagaagcatggatctcggaatccctgacctgctggacgcgtggctggagcccccagaggatatcttctcgacaggatccgtcctggagctgggactccactgcccccctccagaggttccggtaactaggctacaggaacagggactgcaaggctggaagtccggtggggaccgtggctgtggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttgcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttcttctttgggtatagggttgaggggaaataagttttgagtgagaaataaacgttttagctgaaattgtatcccagaagtttgaaataa

SEQ ID NO: 354961 - DNA, 1890 bp, Homo sapiens
cctttgtttacaaccctgccatgatctccctcttgcaaaagcgagggctacagaacaggcattcaggagtcctgtgctccagtcacagccttttctgttcttcagctaggagacaccaaaccctcaggaagatttactatagctaagagaaaactgcagcagaaagggcgcggctacctacttcttaaattccgtttgtggaccctcagactcttagtcccctactcccagatacagcggccctaccgtggctcctggcaagaagcatggatctcggaatccctgacctgctggacgcgtggctggagcccccagaggatatcttctcgacaggatccgtcctggagctgggactccactgcccccctccagaggttccggtaactaggctacaggaacagggactgcaaggctggaagtccggtggggaccgtggctgtggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgggtcttactctgtcatccaggctggagtgcagtggtgcaatcacggctcactgcatcctcaacatcttgggctcaagcaatcctcctgcctcagcctcctgagtagctgggactacagctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttgcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttcttctttgggtatagggttgaggggaaataagttttgagtgagaaataaacgttttagctgaaattgtatcccagaagtttgaaataa

SEQ ID NO: 354962 - DNA, 1830 bp, Homo sapiens
cctttgtttacaaccctgccatgatctccctcttgcaaaagcgagggctacagaacaggcattcaggagtcctgtgctccagtcacagccttttctgttcttcagctaggagacaccaaaccctcaggaagatttactatagctaagagaaaactgcagcagaaagggcgcggctacctacttcttaaattccgtttgtggaccctcagactcttagtcccctactcccagatacagcggccctaccgtggctcctggcaagaagcatggatctcggaatccctgacctgctggacgcgtggctggagcccccagaggatatcttctcgacaggatccgtcctggagctgggactccactgcccccctccagaggttccgggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgggtcttactctgtcatccaggctggagtgcagtggtgcaatcacggctcactgcatcctcaacatcttgggctcaagcaatcctcctgcctcagcctcctgagtagctgggactacagctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttgcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttcttctttgggtatagggttgaggggaaataagttttgagtgagaaataaacgttttagctgaaattgtatcccagaagtttgaaataa

SEQ ID NO: 354963 - DNA, 1792 bp, Homo sapiens
cctttgtttacaaccctgccatgatctccctcttgcaaaagcgagggctacagaacaggcattcaggagtcctgtgctccagtcacagccttttctgttcttcagctaggagacaccaaaccctcaggaagatttactatagctaagagaaaactgcagcagaaagggcgcggctacctacttcttaaattccgtttgtggaccctcagactcttagtcccctactcccagatacagcggccctaccgtggctcctggcaaggtggcatccacttttgtagtaagcatggatctcggaatccctgacctgctggacgcgtggctggagcccccagaggatatcttctcgacaggatccgtcctggagctgggactccactgcccccctccagaggttccggtaactaggctacaggaacagggactgcaaggctggaagtccggtggggaccgtggctgtggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttgcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttcttctttgggtatagggttgaggggaaataagttttgagtgagaaataaacgttttagctgaaattgtatcccagaagtttgaaataa

SEQ ID NO: 354964 - DNA, 1712 bp, Homo sapiens
cctttgtttacaaccctgccatgatctccctcttgcaaaagcgagggctacagaacaggcattcaggagtcctgtgctccagtcacagccttttctgttcttcagctaggagacaccaaaccctcaggaagatttactatagctaagagaaaactgcagcagaaagggcgcggctacctacttcttaaattccgtttgtggaccctcagactcttagtcccctactcccagatacagcggccctaccgtggctcctggcaagaagcatggatctcggaatccctgacctgctggacgcgtggctggagcccccagaggatatcttctcgacaggatccgtcctggagctgggactccactgcccccctccagaggttccgggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttgcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttcttctttgggtatagggttgaggggaaataagttttgagtgagaaataaacgttttagctgaaattgtatcccagaagtttgaaataa

SEQ ID NO: 354965 - DNA, 1732 bp, Homo sapiens
cctttgtttacaaccctgccatgatctccctcttgcaaaagcgagggctacagaacaggcattcaggagtcctgtgctccagtcacagccttttctgttcttcagctaggagacaccaaaccctcaggaagatttactatagctaagagaaaactgcagcagaaagggcgcggctacctacttcttaaattccgtttgtggaccctcagactcttagtcccctactcccagatacagcggccctaccgtggctcctggcaaggtggcatccacttttgtagtaagcatggatctcggaatccctgacctgctggacgcgtggctggagcccccagaggatatcttctcgacaggatccgtcctggagctgggactccactgcccccctccagaggttccgggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttgcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttcttctttgggtatagggttgaggggaaataagttttgagtgagaaataaacgttttagctgaaattgtatcccagaagtttgaaataa

SEQ ID NO: 354966 - DNA, 1689 bp, Homo sapiens
atcctggaagaaagaaaaggtgtagtgtttggggaggtcaacgggctatgctggcttgacagggctgggctcttcagaacagaagcatggatctcggaatccctgacctgctggacgcgtggctggagcccccagaggatatcttctcgacaggatccgtcctggagctgggactccactgcccccctccagaggttccgggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctaggtcagtgttctttgtgggaagggggaaatggcccttcgggactggccctaaccatggggttaagggggtttacccaacctgtgccactacccaggccctgcggctgtcagggtgttcctaagtctcctttctcccagctacctgttttctactccagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttgcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttcttctttgggtatagggttgaggggaaataagttttgagtgagaaataaacgttttagctgaaattgtatcccagaagtttgaaataa

SEQ ID NO: 354967 - DNA, 968 bp, Homo sapiens
cctttgtttacaaccctgccatgatctccctcttgcaaaagcgagggctacagaacaggcattcaggagtcctgtgctccagtcacagccttttctgttcttcagctaggagacaccaaaccctcaggaagatttactatagctaagagaaaactgcagcagaaagggcgcggctacctacttcttaaattccgtttgtggaccctcagactcttagtcccctactcccagatacagcggccctaccgtggctcctggcaagaagcatggatctcggaatccctgacctgctggacgcgtggctggagcccccagaggatatcttctcgacaggatccgtcctggagctgggactccactgcccccctccagaggttccggtaactaggctacaggaacagggactgcaaggctggaagtccggtggggaccgtggctgtggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctagtctgcatttgtttgcatatatgagagggtacctcaaatacttctgttatgtatctgtgattttatttcttctttgggtatagggttgaggggaaataagttttgagtgagaaataaacgttttagctgaaattgtatcccagaagtttgaaataa

SEQ ID NO: 354968 - DNA, 572 bp, Homo sapiens
  misc_feature (31)..(31): n is a, c, g, or t
  misc_feature (33)..(33): n is a, c, g, or t
tcggctctacatgttgtctacggctctaccntnctgctggttcttttgggaaacctctaaaagttcacttaaatacctcccttctccccccaaaaagaccagcagacaagaaaagattacatttattttaagcccattgctgataatttctagcactgggcatgctctaatctgcatggttgctatagctattagttttcagctataatatgagctactcgtcttcagaaatctaattttgatcttgaatattgccgcaggaagatgatcaccttgccaaggaagcatcatgtaatatatcagctcatcagcagggagtgaagaggaagtctgatacaccactggggtccccactagaacctggtcaaatactggagaagaatgaggatagcagtaaagtcaaactcaaaatcagagtaagaaatacaggttaaacctgtattaacagtgtaggatattcaccttcttgtaaatctttttgaatacttgcagtggtttttccttagcaggaacacacgcaacagactgcattataaaactcaaaggtccttctgagacaaggtagagccgag

SEQ ID NO: 354969 - DNA, 5021 bp, Homo sapiens
acagacaagatgtcggcggatggtagcttcgagcccttgcggagaggagcatctctgtgacagaagcttgtcgacggcggcttctaggagctagtcgaaggagcgaggttgaggcgggcagcgacccgtcaggtcgctcacctgggcaccggccagctgcgagacgtgacttggggaccgcaggggagtggagagtgtgaggtgccaaagactagtaatgccccgtatccccctaggaagccgggaagccaagctccgcgggaccgcttcatgccgctgactggtgtagagcccgccagaatgaacaggaagaaaggagacaagggctttgaaagcccaaggccatataaattaacccatcaggtcgtctgcatcaacaacataaatttccagagaaaatctgttgtgggatttgtggaactgactatatttcccacagttgcaaacttgaatagaatcaagttgaacagcaaacagtgtagaatataccgagtaaggatcaatgatttagaggctgcttttatttataatgacccaaccttggaagtttgtcacagtgaatcaaaacagagaaacctcaattatttttccaatgcttatgcagctgcagttagtgctgtggaccctgatgcaggaaatggagaactttgcattaaggttccatcagagctatggaaacacgttgatgagttaaaggtcctgaagatacacatcaatttttctttggatcagcccaaaggaggtcttcattttgtggtacccagtgtagagggaagtatggcagagagaggtgctcatgttttctcttgtgggtatcaaaattctacaagattttggttcccttgtgttgattcatactctgaattgtgtacatggaaattagaatttacagtagatgctgcaatggttgctgtttctaatggcgatttggtggagacagtgtatactcatgatatgaggaagaaaactttccattatatgcttaccattcctacagcagcgtcaaatatctccttggccattggaccatttgaaatactggtagatccatacatgcatgaggttactcatttttgtttgccccaacttcttccattgctgaaacataccacatcataccttcatgaagtctttgaattttatgaagaaattcttacatgtcgttacccatactcctgttttaagactgtcttcattgatgaggcttatgttgaagtggctgcttatgcttccatgagcatttttagcacaaatcttttacacagtgccatgattatagatgagacacctttgactagaaggtgtttagcccaatccttggcccagcagttttttggttgtttcatatctagaatgtcttggtctgatgaatgggtgctgaagggaatttcaggctatatctatggactttggatgaaaaaaacttttggtgttaatgagtaccgccattggattaaagaggagctagacaaaatagtggcatatgaactaaaaactggtggggttttactacatcccatatttggtggaggaaaagagaaggataatccggcttcccatctacacttttcaataaagcatccacatacactgtcctgggaatactacactatgtttcagtgtaaagcccaccttgtgatgagattgattgaaaataggatcagtatggaatttatgctacaagttttcaataaactgctaagtctggctagtactgcttcatctcagaagttccagtcacatatgtggagtcagatgttggtttccacatctgggtttttgaaatccatttcaaatgtctctggcaaagatattcagccgttaataaagcagtgggtagatcagagtggagtggtaaaattttatggaagttttgcatttaatagaaaacgaaatgtcttggaactggaaataaaacaggactatacatctcctggaactcagaaatacgtgggaccacttaaagtgacagtgcaggagttagatggatccttcaatcatacactgcaaattgaagaaaacagccttaaacatgatataccctgccattccaaaagtagaaggaataaaaagaaaaaaatcccactgatgaatggagaagaagttgatatggatctttctgcaatggatgctgattcccctttgctgtggataaggatagacccagatatgtcagtattgaggaaggtagaatttgagcaagctgattttatgtggcagtatcagctccgctatgagagagatgttgttgcacagcaggaatccattttggctttggaaaaattccctactccagcatctcggcttgcactcactgatatattagaacaagagcagtgtttctacagagtaagaatgtcagcttgcttctgtcttgcaaagattgcaaattcaatggtgagcacatggacaggaccaccagccatgaagtcactcttcactaggatgttttgttgtaaaagttgtccaaacattgtgaaaacaaacaactttatgagctttcaaagctattttctacagaagactatgccagttgcaatggctttattaagagatgttcataatctttgtcctaaagaagtcttaacgtttattttagacttaatcaagtacaatgacaacaggaaaaataagttttcagataactattatcgtgcagaaatgattgatgccctggccaactctgttacacctgcagtcagtgtgaataatgaagttagaactttggataacttaaatcctgatgtgcgactcattcttgaagaaatcaccagatttttgaatatggaaaaacttcttccgagttacaggcataccatcactgtcagttgtttgagagccatacgggtacttcagaagaacggacatgtgccaagtgatccagctctttttaaatcttatgctgaatatggccactttgtggacattaggatagcagctttggaagcagttgttgattatactaaagtggacagaagttatgaagaactgcaatggctacttaatatgattcagaatgaccctgtaccctatgtaaggcataagattctcaacatgttgactaagaacccaccatttactaagaacatggagtctcccttatgcaatgaagccctggtagatcaactttggaaacttatgaattctggtacttcacatgactggaggttacggtgtggtgctgtggacttgtacttcacactttttggcctcagtagaccttcctgtttacccttgccagagcttgggttggttcttaatctaaaggagaaaaaagctgtcttgaatcctaccataattccagagtcagtagcaggcaaccaagaagctgcaaataatccaagcagtcacccacagctagttggatttcagaaccctttttccagttctcaagatgaggaggagattgatatggatactgttcatgatagccaggccttcatttcccatcatttaaacatgcttgaaaggccgtcaactccagggctctcgaaatatcggccagctagctcccgatctgctttaataccccagcactcagcaggctgtgacagcacacccaccacaaaaccccagtggagtttggaacttgcacggaagggaacaggtaaagaacaagcacctttggagatgagtatgcatccagcggcaagcgctccactctcagtctttactaaggaatctacagcctccaaacacagtgaccaccatcaccaccatcaccatgagcacaagaaaaagaagaagaagcataaacataagcacaaacacaagcataagcatgacagtaaagaaaaggacaaggagcctttcactttctccagccctgccagtggcaggtctattcgttctccttccctttcagactgagaaggggacaaaaagacctttcctttcatgtccagaagaatgtatgtaactaaagctttgtcctctgtgaagaattataaaagggaggggggaaaggattcgcctctcctacagaaattctgaattcatttaagttctaagcatttgatttatgttatttatacagttgggatctaattaggaaaatgtgttttgtagttctggataaactatttcatccgctgtttcctccccaaaacacacacacagagcaaactccctttcataaaagccctcatatccactggcagtccccgttcgcatcatggtctccatgtgtaccgccaaagtcaattatgtttgaaagcctttggtggatgttatggggcaaagttatgatttacacagaagcaactgccaaatctgtggtgcaaccactatctccagtgaaatattgtataacaccatttggaactactgaaaagacagtggcttttctacagtactcttccttattgcaccatttttgtattaacgtagaaactaagcatcagaatttatgaacaaagaatatgttatttttccttttgctctaaaatactgagatttggggaagcaattctttttttaaaaaaattttgaataactatcttttgataacacattcggcggttacgatgttggaatttagcagaactatcaaatccaaaattattttcaaatcaagatgtttaaattataagtttttttgttttgttttccagtaagtataaatgaaaatattcatatgtaaaatatgttttgcttaatgtggacaatttacacacccaacacatactgtttccaaaattatttctatatgacacaaagtatgatacctttaaaaaggtgagcttatatattgtttattaacctggaaatagacaatttggctctcataccataagcatttaaaaacatatgaaatattttgatttctttatatggtggtgtgtttttatttctgaattttccatgtgctttaatatttgtttaagaatattttttatatctgttcaatttttatcattccccttatcattagaaagtttgacaaaaatacttgaatcttggacctctaaatatacttttagttgtgtttaacttgtttaataaataactttttaagttga

SEQ ID NO: 354970 - DNA, 3926 bp, Homo sapiens
gattcctgactcatttcagttcctttttactcgcctaaattttttgaggcaaaatacagagaaggaaaaataaacttggagacagctcagagagattgagaacagccataagaaaaagttgccaggctgctgtccagccctgaagtcataaagtagagaagtctttggcttttgtcattctgccagctgtgtaggctgctttatttataagaacataaactactctttaaatacatttcacttattttaagaaatttacattctgattttaggaaatgagaattcacagtttaattctaaaatttggtatgtaaaaaaatgttactttacaaattttactgactcctatttttatatattttttaggagctagacaaaatagtggcatatgaactaaaaactggtggggttttactacatcccatatttggtggaggaaaagagaaggataatccggcttcccatctacacttttcaataaagcatccacatacactgtcctgggaatactacactatgtttcagtgtaaagcccaccttgtgatgagattgattgaaaataggatcagtatggaatttatgctacaagttttcaataaactgctaagtctggctagtactgcttcatctcagaagttccagtcacatatgtggagtcagatgttggtttccacatctgggtttttgaaatccatttcaaatgtctctggcaaagatattcagccgttaataaagcagtgggtagatcagagtggagtggtaaaattttatggaagttttgcatttaatagaaaacgaaatgtcttggaactggaaataaaacaggactatacatctcctggaactcagaaatacgtgggaccacttaaagtgacagtgcaggagttagatggatccttcaatcatacactgcaaattgaagaaaacagccttaaacatgatataccctgccattccaaaagtagaaggaataaaaagaaaaaaatcccactgatgaatggagaagaagttgatatggatctttctgcaatggatgctgattcccctttgctgtggataaggatagacccagatatgtcagtattgaggaaggtagaatttgagcaagctgattttatgtggcagtatcagctccgctatgagagagatgttgttgcacagcaggaatccattttggctttggaaaaattccctactccagcatctcggcttgcactcactgatatattagaacaagagcagtgtttctacagagtaagaatgtcagcttgcttctgtcttgcaaagattgcaaattcaatggtgagcacatggacaggaccaccagccatgaagtcactcttcactaggatgttttgttgtaaaagttgtccaaacattgtgaaaacaaacaactttatgagctttcaaagctattttctacagaagactatgccagttgcaatggctttattaagagatgttcataatctttgtcctaaagaagtcttaacgtttattttagacttaatcaagtacaatgacaacaggaaaaataagttttcagataactattatcgtgcagaaatgattgatgccctggccaactctgttacacctgcagtcagtgtgaataatgaagttagaactttggataacttaaatcctgatgtgcgactcattcttgaagaaatcaccagatttttgaatatggaaaaacttcttccgagttacaggcataccatcactgtcagttgtttgagagccatacgggtacttcagaagaacggacatgtgccaagtgatccagctctttttaaatcttatgctgaatatggccactttgtggacattaggatagcagctttggaagcagttgttgattatactaaagtggacagaagttatgaagaactgcaatggctacttaatatgattcagaatgaccctgtaccctatgtaaggcataagattctcaacatgttgactaagaacccaccatttactaagaacatggagtctcccttatgcaatgaagccctggtagatcaactttggaaacttatgaattctggtacttcacatgactggaggttacggtgtggtgctgtggacttgtacttcacactttttggcctcagtagaccttcctgtttacccttgccagagcttgggttggttcttaatctaaaggagaaaaaagctgtcttgaatcctaccataattccagagtcagtagcaggcaaccaagaagctgcaaataatccaagcagtcacccacagctagttggatttcagaaccctttttccagttctcaagatgaggaggagattgatatggatactgttcatgatagccaggccttcatttcccatcatttaaacatgcttgaaaggccgtcaactccagggctctcgaaatatcggccagctagctcccgatctgctttaataccccagcactcagcaggctgtgacagcacacccaccacaaaaccccagtggagtttggaacttgcacggaagggaacaggtaaagaacaagcacctttggagatgagtatgcatccagcggcaagcgctccactctcagtctttactaaggaatctacagcctccaaacacagtgaccaccatcaccaccatcaccatgagcacaagaaaaagaagaagaagcataaacataagcacaaacacaagcataagcatgacagtaaagaaaaggacaaggagcctttcactttctccagccctgccagtggcaggtctattcgttctccttccctttcagactgagaaggggacaaaaagacctttcctttcatgtccagaagaatgtatgtaactaaagctttgtcctctgtgaagaattataaaagggaggggggaaaggattcgcctctcctacagaaattctgaattcatttaagttctaagcatttgatttatgttatttatacagttgggatctaattaggaaaatgtgttttgtagttctggataaactatttcatccgctgtttcctccccaaaacacacacacagagcaaactccctttcataaaagccctcatatccactggcagtccccgttcgcatcatggtctccatgtgtaccgccaaagtcaattatgtttgaaagcctttggtggatgttatggggcaaagttatgatttacacagaagcaactgccaaatctgtggtgcaaccactatctccagtgaaatattgtataacaccatttggaactactgaaaagacagtggcttttctacagtactcttccttattgcaccatttttgtattaacgtagaaactaagcatcagaatttatgaacaaagaatatgttatttttccttttgctctaaaatactgagatttggggaagcaattctttttttaaaaaaattttgaataactatcttttgataacacattcggcggttacgatgttggaatttagcagaactatcaaatccaaaattattttcaaatcaagatgtttaaattataagtttttttgttttgttttccagtaagtataaatgaaaatattcatatgtaaaatatgttttgcttaatgtggacaatttacacacccaacacatactgtttccaaaattatttctatatgacacaaagtatgatacctttaaaaaggtgagcttatatattgtttattaacctggaaatagacaatttggctctcataccataagcatttaaaaacatatgaaatattttgatttctttatatggtggtgtgtttttatttctgaattttccatgtgctttaatatttgtttaagaatattttttatatctgttcaatttttatcattccccttatcattagaaagtttgacaaaaatacttgaatcttggacctctaaatatacttttagttgtgtttaacttgtttaataaataactttttaagttga

SEQ ID NO: 354971 - DNA, 1836 bp, Homo sapiens
gcttcttttagaggctggaccacataatcttttctttctcttaatatctttgaagaaagaaactactttttattttaagattatatgggggtatatcctatggcctctctgctacttttcctaagagctaatatccaaacataacatgatgtaatggttcttttatcctctgttttatgtgtgtgtgttttagttttccagttctcaagatgaggaggagattgatatggatactgttcatgatagccaggccttcatttcccatcatttaaacatgcttgaaaggccgtcaactccagggctctcgaaatatcggccagctagctcccgatctgctttaataccccagcactcagcaggctgtgacagcacacccaccacaaaaccccagtggagtttggaacttgcacggaagggaacaggtaaagaacaagcacctttggagatgagtatgcatccagcggcaagcgctccactctcagtctttactaaggaatctacagcctccaaacacagtgaccaccatcaccaccatcaccatgagcacaagaaaaagaagaagaagcataaacataagcacaaacacaagcataagcatgacagtaaagaaaaggacaaggagcctttcactttctccagccctgccagtggcaggtctattcgttctccttccctttcagactgagaaggggacaaaaagacctttcctttcatgtccagaagaatgtatgtaactaaagctttgtcctctgtgaagaattataaaagggaggggggaaaggattcgcctctcctacagaaattctgaattcatttaagttctaagcatttgatttatgttatttatacagttgggatctaattaggaaaatgtgttttgtagttctggataaactatttcatccgctgtttcctccccaaaacacacacacagagcaaactccctttcataaaagccctcatatccactggcagtccccgttcgcatcatggtctccatgtgtaccgccaaagtcaattatgtttgaaagcctttggtggatgttatggggcaaagttatgatttacacagaagcaactgccaaatctgtggtgcaaccactatctccagtgaaatattgtataacaccatttggaactactgaaaagacagtggcttttctacagtactcttccttattgcaccatttttgtattaacgtagaaactaagcatcagaatttatgaacaaagaatatgttatttttccttttgctctaaaatactgagatttggggaagcaattctttttttaaaaaaattttgaataactatcttttgataacacattcggcggttacgatgttggaatttagcagaactatcaaatccaaaattattttcaaatcaagatgtttaaattataagtttttttgttttgttttccagtaagtataaatgaaaatattcatatgtaaaatatgttttgcttaatgtggacaatttacacacccaacacatactgtttccaaaattatttctatatgacacaaagtatgatacctttaaaaaggtgagcttatatattgtttattaacctggaaatagacaatttggctctcataccataagcatttaaaaacatatgaaatattttgatttctttatatggtggtgtgtttttatttctgaattttccatgtgctttaatatttgtttaagaatattttttatatctgttcaatttttatcattccccttatcattagaaagtttgacaaaaatacttgaatcttggacctctaaatatacttttagttgtgtttaacttgtttaataaataactttttaagttga

SEQ ID NO: 354972 - DNA, 1579 bp, Homo sapiens
gtgtgtaactaattacatgtcttatttagatacttctcccattcctgatagaagtgataaaaacttaggaatccctctttacatactgtcatcagcttcctctttctttagtctggctttccgtatcatcagcaggaattcatttgggtatttttaatcttgaaggtaaagaacaagcacctttggagatgagtatgcatccagcggcaagcgctccactctcagtctttactaaggaatctacagcctccaaacacagtgaccaccatcaccaccatcaccatgagcacaagaaaaagaagaagaagcataaacataagcacaaacacaagcataagcatgacagtaaagaaaaggacaaggagcctttcactttctccagccctgccagtggcaggtctattcgttctccttccctttcagactgagaaggggacaaaaagacctttcctttcatgtccagaagaatgtatgtaactaaagctttgtcctctgtgaagaattataaaagggaggggggaaaggattcgcctctcctacagaaattctgaattcatttaagttctaagcatttgatttatgttatttatacagttgggatctaattaggaaaatgtgttttgtagttctggataaactatttcatccgctgtttcctccccaaaacacacacacagagcaaactccctttcataaaagccctcatatccactggcagtccccgttcgcatcatggtctccatgtgtaccgccaaagtcaattatgtttgaaagcctttggtggatgttatggggcaaagttatgatttacacagaagcaactgccaaatctgtggtgcaaccactatctccagtgaaatattgtataacaccatttggaactactgaaaagacagtggcttttctacagtactcttccttattgcaccatttttgtattaacgtagaaactaagcatcagaatttatgaacaaagaatatgttatttttccttttgctctaaaatactgagatttggggaagcaattctttttttaaaaaaattttgaataactatcttttgataacacattcggcggttacgatgttggaatttagcagaactatcaaatccaaaattattttcaaatcaagatgtttaaattataagtttttttgttttgttttccagtaagtataaatgaaaatattcatatgtaaaatatgttttgcttaatgtggacaatttacacacccaacacatactgtttccaaaattatttctatatgacacaaagtatgatacctttaaaaaggtgagcttatatattgtttattaacctggaaatagacaatttggctctcataccataagcatttaaaaacatatgaaatattttgatttctttatatggtggtgtgtttttatttctgaattttccatgtgctttaatatttgtttaagaatattttttatatctgttcaatttttatcattccccttatcattagaaagtttgacaaaaatacttgaatcttggacctctaaatatacttttagttgtgtttaacttgtttaataaataactttttaagttga

SEQ ID NO: 354973 - DNA, 1349 bp, Homo sapiens
  misc_feature (35)..(36): n is a, c, g, or t
agaggatccgtatggacactgcgctacgcgtatgnncatcaccaccatcaccatgagcacaagaaaaagaagaagaagcataaacataagcacaaacacaagcataagcatgacagtaaagaaaaggacaaggagcctttcactttctccagccctgccagtggcaggtctattcgttctccttccctttcagactgagaaggggacaaaaagacctttcctttcatgtccagaagaatgtatgtaactaaagctttgtcctctgtgaagaattataaaagggaggggggaaaggattcgcctctcctacagaaattctgaattcatttaagttctaagcatttgatttatgttatttatacagttgggatctaattaggaaaatgtgttttgtagttctggataaactatttcatccgctgtttcctccccaaaacacacacacagagcaaactccctttcataaaagccctcatatccactggcagtccccgttcgcatcatggtctccatgtgtaccgccaaagtcaattatgtttgaaagcctttggtggatgttatggggcaaagttatgatttacacagaagcaactgccaaatctgtggtgcaaccactatctccagtgaaatattgtataacaccatttggaactactgaaaagacagtggcttttctacagtactcttccttattgcaccatttttgtattaacgtagaaactaagcatcagaatttatgaacaaagaatatgttatttttccttttgctctaaaatactgagatttggggaagcaattctttttttaaaaaaattttgaataactatcttttgataacacattcggcggttacgatgttggaatttagcagaactatcaaatccaaaattattttcaaatcaagatgtttaaattataagtttttttgttttgttttccagtaagtataaatgaaaatattcatatgtaaaatatgttttgcttaatgtggacaatttacacacccaacacatactgtttccaaaattatttctatatgacacaaagtatgatacctttaaaaaggtgagcttatatattgtttattaacctggaaatagacaatttggctctcataccataagcatttaaaaacatatgaaatattttgatttctttatatggtggtgtgtttttatttctgaattttccatgtgctttaatatttgtttaagaatattttttatatctgttcaatttttatcattccccttatcattagaaagtttgacaaaaatacttgaatcttggacctctaaatatacttttagttgtgtttaacttgtttaataaataactttttaagttga

SEQ ID NO: 354974 - DNA, 1423 bp, Homo sapiens
  misc_feature (1384)..(1384): n is a, c, g, or t
  misc_feature (1410)..(1410): n is a, c, g, or t
  misc_feature (1423)..(1423): n is a, c, g, or t
acagacaagatgtcggcggatggtagcttcgagcccttgcggagaggagcatctctgtgacagaagcttgtcgacggcggcttctaggagctagtcgaaggagcgaggttgaggcgggcagcgacccgtcaggtcgctcacctgggcaccggccagctgcgagacgtgacttggggaccgcaggggagtggagagtgtgaggtgccaaagactagtaatgccccgtatccccctaggaagccgggaagccaagctccgcgggaccgcttcatgccgctgactggtgtagagcccgccagaatgaacaggaagaaaggagacaagggctttgaaagcccaaggccatataaattaacccatcaggtcgtctgcatcaacaacataaatttccagagaaaatctgttgtgggatttgtggaactgactatatttcccacagttgcaaacttgaatagaatcaagttgaacagcaaacagtgtagaatataccgagtaaggatcaatgatttagaggctgcttttatttataatgacccaaccttggaagtttgtcacagtgaatcaaaacagagaaacctcaattatttttccaatgcttatgcagctgcagttagtgctgtggaccctgatgcaggaaatggagaactttgcattaaggttccatcagagctatggaaacacgttgatgagttaaaggtcctgaagatacacatcaatttttctttggatcagcccaaaggaggtcttcattttgtggtacccagtgtagagggaagtatggcagagagaggtgctcatgttttctcttgtgggtatcaaaattctacaagattttggttcccttgtgttgattcatactctgaattgtgtacatggaaattagaatttacagtagatgctgcaatggttgctgtttctaatggcgatttggtggagacagtgtatactcatgatatgaggaagaaaactttccattatatgcttaccattcctacagcagcgtcaaatatctccttggccattggaccatttgaaatactggtagatccatacatgcatgaggttactcatttttgtttgccccaacttcttccattgctgaaacataccacatcataccttcatgaagtctttgaattttatgaagaaattcttacatgtcgttacccatactcctgttttaagactgtcttcattgatgaggcttatgttgaagtggctgcttatgcttccatgagcatttttagcacaaatcttttacacagtgccatgattatagatgagacacctttgactagaaggtgtttagcccaatccttggcccagcagttttttggttgtttcatatctagaatgtcttggtctgatgaatgggcgctgctgnaaatgctgacgggatcctctaccaanagaggcatcccan

SEQ ID NO: 354975 - DNA, 467 bp, Homo sapiens
tgttaataattttcattttctttatgaaggcagggaaatacacactacacttattccgttatcctctttgacattatctgaggagtttttatgattaaaagtaatttatgctttgactttttgcttaggtctgatgaatgggtgctgaagggaatttcaggctatatctatggactttggatgaaaaaaacttttggtgttaatgagtaccgccattggattaaagaggtaataacagctagatcccttatccacttacaagtcttatgtcctccatttttaatgactgtaaaatacttttaaaatactgcttgaaaatccctaatttttcccagcaaaatgggaattgatttactgagaaagactaatggtctattttatctaatctccattgtcaacattggcccctaaaaacctttttttcccctaaggaagagaatatttaagtttcttaaacatcagattgg

SEQ ID NO: 354976 - DNA, 476 bp, Homo sapiens
  misc_feature (437)..(437): n is a, c, g, or t
  misc_feature (463)..(463): n is a, c, g, or t
  misc_feature (476)..(476): n is a, c, g, or t
cagaacagctatgccatgttgcgattcgagccggtccggtaggattccagcagcgtcaaatatctccttggccattggaccatttgaaatactggtagatccatacatgcatgaggttactcatttttgtttgccccaacttcttccattgctgaaacataccacatcataccttcatgaagtctttgaattttatgaagaaattcttacatgtcgttacccatactcctgttttaagactgtcttcattgatgaggcttatgttgaagtggctgcttatgcttccatgagcatttttagcacaaatcttttacacagtgccatgattatagatgagacacctttgactagaaggtgtttagcccaatccttggcccagcagttttttggttgtttcatatctagaatgtcttggtctgatgaatgggcgctgctgnaaatgctgacgggatcctctaccaanagaggcatcccan

SEQ ID NO: 354977 - DNA, 5177 bp, Homo sapiens
acagacaagatgtcggcggatggtagcttcgagcccttgcggagaggagcatctctgtgacagaagcttgtcgacggcggcttctaggagctagtcgaaggagcgaggttgaggcgggcagcgacccgtcaggtcgctcacctgggcaccggccagctgcgagacgtgacttggggaccgcaggggagtggagagtgtgaggtgccaaagactagtaatgccccgtatccccctaggaagccgggaagccaagctccgcgggaccgcttcatgccgctgactggtgtagagcccgccagaatgaacaggaagaaaggagacaagggctttgaaagcccaaggccatataaattaacccatcaggtcgtctgcatcaacaacataaatttccagagaaaatctgttgtgggatttgtggaactgactatatttcccacagttgcaaacttgaatagaatcaagttgaacagcaaacagtgtagaatataccgagtaaggatcaatgatttagaggctgcttttatttataatgacccaaccttggaagtttgtcacagtgaatcaaaacagagaaacctcaattatttttccaatgcttatgcagctgcagttagtgctgtggaccctgatgcaggaaatggagaactttgcattaaggttccatcagagctatggaaacacgttgatgagttaaaggtcctgaagatacacatcaatttttctttggatcagcccaaaggaggtcttcattttgtggtacccagtgtagagggaagtatggcagagagaggtgctcatgttttctcttgtgggtatcaaaattctacaagattttggttcccttgtgttgattcatactctgaattgtgtacatggaaattagaatttacagtagatgctgcaatggttgctgtttctaatggcgatttggtggagacagtgtatactcatgatatgaggaagaaaactttccattatatgcttaccattcctacagcagcgtcaaatatctccttggccattggaccatttgaaatactggtagatccatacatgcatgaggttactcatttttgtttgccccaacttcttccattgctgaaacataccacatcataccttcatgaagtctttgaattttatgaagaaattcttacatgtcgttacccatactcctgttttaagactgtcttcattgatgaggcttatgttgaagtggctgcttatgcttccatgagcatttttagcacaaatcttttacacagtgccatgattatagatgagacacctttgactagaaggtgtttagcccaatccttggcccagcagttttttggttgtttcatatctagaatgtcttggtctgatgaatgggtgctgaagggaatttcaggctatatctatggactttggatgaaaaaaacttttggtgttaatgagtaccgccattggattaaagaggagctagacaaaatagtggcatatgaactaaaaactggtggggttttactacatcccatatttggtggaggaaaagagaaggataatccggcttcccatctacacttttcaataaagcatccacatacactgtcctgggaatactacactatgtttcagtgtaaagcccaccttgtgatgagattgattgaaaataggatcagtatggaatttatgctacaagttttcaataaactgctaagtctggctagtactgcttcatctcagaagttccagtcacatatgtggagtcagatgttggtttccacatctgggtttttgaaatccatttcaaatgtctctggcaaagatattcagccgttaataaagcagtgggtagatcagagtggagtggtaaaattttatggaagttttgcatttaatagaaaacgaaatgtcttggaactggaaataaaacaggactatacatctcctggaactcagaaatacgtgggaccacttaaagtgacagtgcaggagttagatggatccttcaatcatacactgcaaattgaagaaaacagccttaaacatgatataccctgccattccaaaagtagaaggaataaaaagaaaaaaatcccactgatgaatggagaagaagttgatatggatctttctgcaatggatgctgattcccctttgctgtggataaggatagacccagatatgtcagtattgaggaaggtagaatttgagcaagctgattttatgtggcagtatcagctccgctatgagagagatgttgttgcacagcaggaatccattttggctttggaaaaattccctactccagcatctcggcttgcactcactgatatattagaacaagagcagtgtttctacagagtaagaatgtcagcttgcttctgtcttgcaaagattgcaaattcaatggtgagcacatggacaggaccaccagccatgaagtcactcttcactaggatgttttgttgtaaaagttgtccaaacattgtgaaaacaaacaactttatgagctttcaaagctattttctacagaagactatgccagttgcaatggctttattaagagatgttcataatctttgtcctaaagaagtcttaacgtttattttagacttaatcaagtacaatgacaacaggaaaaataagttttcagataactattatcgtgcagaaatgattgatgccctggccaactctgttacacctgcagtcagtgtgaataatgaagttagaactttggataacttaaatcctgatgtgcgactcattcttgaagaaatcaccagatttttgaatatggaaaaacttcttccgagttacaggcataccatcactgtcagttgtttgagagccatacgggtacttcagaagaacggacatgtgccaagtgatccagctctttttaaatcttatgctgaatatggccactttgtggacattaggatagcagctttggaagcagttgttgattatactaaagtggacagaagttatgaagaactgcaatggctacttaatatgattcagaatgaccctgtaccctatgtaaggcataagattctcaacatgttgactaagaacccaccatttactaagaacatggagtctcccttatgcaatgaagccctggtagatcaactttggaaacttatgaattctggtacttcacatgactggaggttacggtgtggtgctgtggacttgtacttcacactttttggcctcagtagaccttcctgtttacccttgccagagcttgggttggttcttaatctaaaggagaaaaaagctgtcttgaatcctaccataattccagagtcagtagcaggcaaccaagaagctgcaaataatccaagcagtcacccacagctagttggatttcagaaccctgaagatgatcaccttgccaaggaagcatcatgtaatatatcagctcatcagcagggagtgaagaggaagtctgatacaccactggggtccccactagaacctggtcaaatactggagaagaatgaggatagcagtaaagtcaaactcaaaatcagattttccagttctcaagatgaggaggagattgatatggatactgttcatgatagccaggccttcatttcccatcatttaaacatgcttgaaaggccgtcaactccagggctctcgaaatatcggccagctagctcccgatctgctttaataccccagcactcagcaggctgtgacagcacacccaccacaaaaccccagtggagtttggaacttgcacggaagggaacaggtaaagaacaagcacctttggagatgagtatgcatccagcggcaagcgctccactctcagtctttactaaggaatctacagcctccaaacacagtgaccaccatcaccaccatcaccatgagcacaagaaaaagaagaagaagcataaacataagcacaaacacaagcataagcatgacagtaaagaaaaggacaaggagcctttcactttctccagccctgccagtggcaggtctattcgttctccttccctttcagactgagaaggggacaaaaagacctttcctttcatgtccagaagaatgtatgtaactaaagctttgtcctctgtgaagaattataaaagggaggggggaaaggattcgcctctcctacagaaattctgaattcatttaagttctaagcatttgatttatgttatttatacagttgggatctaattaggaaaatgtgttttgtagttctggataaactatttcatccgctgtttcctccccaaaacacacacacagagcaaactccctttcataaaagccctcatatccactggcagtccccgttcgcatcatggtctccatgtgtaccgccaaagtcaattatgtttgaaagcctttggtggatgttatggggcaaagttatgatttacacagaagcaactgccaaatctgtggtgcaaccactatctccagtgaaatattgtataacaccatttggaactactgaaaagacagtggcttttctacagtactcttccttattgcaccatttttgtattaacgtagaaactaagcatcagaatttatgaacaaagaatatgttatttttccttttgctctaaaatactgagatttggggaagcaattctttttttaaaaaaattttgaataactatcttttgataacacattcggcggttacgatgttggaatttagcagaactatcaaatccaaaattattttcaaatcaagatgtttaaattataagtttttttgttttgttttccagtaagtataaatgaaaatattcatatgtaaaatatgttttgcttaatgtggacaatttacacacccaacacatactgtttccaaaattatttctatatgacacaaagtatgatacctttaaaaaggtgagcttatatattgtttattaacctggaaatagacaatttggctctcataccataagcatttaaaaacatatgaaatattttgatttctttatatggtggtgtgtttttatttctgaattttccatgtgctttaatatttgtttaagaatattttttatatctgttcaatttttatcattccccttatcattagaaagtttgacaaaaatacttgaatcttggacctctaaatatacttttagttgtgtttaacttgtttaataaataactttttaagttga

SEQ ID NO: 354978 - DNA, 838 bp, Homo sapiens
ggcggcgccgcggaggacggagcggaagtgctcgctgcagcttcccggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgaggga

SEQ ID NO: 354979 - DNA, 2361 bp, Homo sapiens
ggcggcgccgcggaggacggagcggaagtgctcgctgcagcttcccggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatattttaattgtttgagattattttgacacatttctttgatacgtagagtgttttgtttttaatttaaatctgtcctcatgcaaccctccatgaggggcagcgaagtggcaggggagcagactggctttgtaggttcagcactcggccccccactgcgggagaggcggaacccacttgcatgtcagcgtttttgattcgagaaaagaaatactctcaacgttttaccaagtgattttacctccacctttactaaagtctttacctaaaacatggcagtcgctggacacaggaaagcccaccttttgtttggccttttcgaaaggtgacccatattgcacagcagaacatcacagctgtggtcccagatgagacactgacatgcgagtgaaggcctctcctcctgggccccgggctgcgcaggctcctcactctgggcggtgtttcctgtctcagaattgacacggtgaatgcttagtgtctggattttcttgtgccagtgtttacatatctgacatcgagctcctctaagaggccacgttcaagcttgtgtgtccctgacccaagatagccagtgctgctcccaggtggtacttctggtaccgtgttgagacacttgggattctcagactgtggacaggagtgtttgtcatttttcatactgttttcttaataagcgctcaggcctaaggtgtgacaggaagtcgcacgcgcttggccagagcacagtgaagcaaaggactgggtgctgatggatggagccacggcggcatctgcccacccggccggagcccccagtgcctctcctggtggtcctcccagtctagagggtcacggcccccccgccctcctccgtctctggcaagctgaccttgactaacccaggaatacagggtcatcctcattcctaagtaagtcaaacagcaagacatggtttgcgcgggtctttgccggaagccggtcctgctggccaggtgttttacgtcagcagggaaatgtggca

SEQ ID NO: 354980 - DNA, 2009 bp, Homo sapiens
ggcggcgccgcggaggacggagcggaagtgctcgctgcagcttcccggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcagtttcctaattccatctcactggagatgtttaaagttggcctctatcctaatgactcaaaacttggttcttaactaccatgattgcttttgagggcccggaattataaatatatattatattttaattgtttgagattattttgacacatttctttgatacgtagagtgttttgtttttaatttaaatctgtcctcatgcaaccctccatgaggggcagcgaagtggcaggggagcagactggctttgtaggttcagcactcggccccccactgcgggagaggcggaacccacttgcatgtcagcgtttttgattcgagaaaagaaatactctcaacgttttaccaagtgattttacctccacctttactaaagtctttacctaaaacatggcagtcgctggacacaggaaagcccaccttttgtttggccttttcgaaaggtgacccatattgcacagcagaacatcacagctgtggtcccagatgagacactgacatgcgagtgaaggcctctcctcctgggccccgggctgcgcaggctcctcactctgggcggtgtttcctgtctcagaattgacacggtgaatgcttagtgtctggattttcttgtgccagtgtttacatatctgacatcgagctcctctaagaggccacgttcaagcttgtgtgtccctgacccaagatagccagtgctgctcccaggtggtacttctggtaccgtgttgagacacttgggattctcagactgtggacaggagtgtttgtcatttttcatactgttttcttaataagcgctcaggcctaaggtgtgacaggaagtcgcacgcgcttggccagagcacagtgaagcaaaggactgggtgctgatggatggagccacggcggcatctgcccacccggccggagcccccagtgcctctcctggtggtcctcccagtctagagggtcacggcccccccgccctcctccgtctctggcaagctgaccttgactaacccaggaatacagggtcatcctcattcctaagtaagtcaaacagcaagacatggtttgcgcgggtctttgccggaagccggtcctgctggccaggtgttttacgtcagcagggaaatgtggca

SEQ ID NO: 354981 - DNA, 1389 bp, Homo sapiens
ggcggcgccgcggaggacggagcggaagtgctcgctgcagcttcccggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggaaaaaaaaaaaaaaaaacaaaaaaaaaaaaaaaaaaaaaaaaaaaaacacacccaaaaacaacacaccccacaaacgcaaacaacaaaaaaagaggaggccgacgccgacgccccacgcacaaccactacagaggaagaccgacgaccagacgagaagagacaagagacacccgcagagaacacgaacgccagcacacagaaccaagcgacacgcccgcgcacgcgagaggcgacacgaccggcgacgacagagcgggcgcgaggagaggccgaaagccaccgcacaagcgcgaaccgcggagaggaacgacgaccgagcgcacacgagacaaaaaaacagcaacgaacaagagaaagaaaaacagacagcaacggacacagaacacgccgcatggcacgaagcacgtaagaaagcagaccgcaagcaaagacgacgccccacaagctagaggacacgaacaacgagcagacagcggggccgaagaacaggagccgaaggatgcgggagaacaggcagcgaggcccgcgcccgcgacgacgcaaagagcagg

SEQ ID NO: 354982 - DNA, 1449 bp, Homo sapiens
caaaattacggctaggtacgaggctggggttacggagccggagcgcagcgcctgcggccgcccgtgccccgccgtcctccttcccgcggccgtgagggagaccgcggctcggccgtagcggagctgcgaggtggcagggcccagccccgaaccagacaagggacccctcaaggagcttcattctagcaggagaaaattgagaagtaaaccagaaagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatattttaattgtttga

SEQ ID NO: 354983 - DNA, 1486 bp, Homo sapiens
ggcggcgccgcggaggacggagcggaagtgctcgctgcagcttcccggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttgggatgcttctgtttgcggggacggtcggtgcagctgcaaggctggaggcggccggcaggtgcccggtgctggctgcagatgcggcgctaaccttctctccccacttgaaggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatattttaattgtttga

SEQ ID NO: 354984 - DNA, 1445 bp, Homo sapiens
caaaattacggctaggtacgaggctggggttacggagccggagcgcagcgcctgcggccgcccgtgccccgccgtcctccttcccgcggccgtgagggagaccgcggctcggccgtagcggagctgcgagagcctcattttacagatgaggaaactgaggctggctgcgtgctcagagggtttgctgaaggcctcacagccgcttagcacagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatattttaattgtttga

SEQ ID NO: 354985 - DNA, 1495 bp, Homo sapiens
gggaggtccctgttttggaggagctaggagcgttgccggcccctgaagtggagcgagagggaggtgcttctgccgtttctcctgccaggggaggtcccggcttccctgtgcaggctccggaccaagccccttcagcttctccctccggatcgatgtgctgctgttaacccgtgaggagcgcggcggcggcggcggcagcggaagcactggtgttgctgacagtgcttaattctgctcctctcctgggcggcgggcatgggagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatattttaattgtttga

SEQ ID NO: 354986 - DNA, 2066 bp, Homo sapiens
gctgttctagaggtccctgcacgtgtgtcatacgtgcactgtgtcatactgcactggttgttcataccccccctgacattactctcatcacctccagtccagtaaaagtgctttaatgggaaacagtctgagtaaaacggggaaacttacaaggagctataggacgaacaatgtgacgggtggctttcagatggcctggctttggcctaaatagggtggccattccaggtgacacattttagtgtagcctctatttaaatatggagttctttcagtggagagtaaaggtgctcctcctctgtgtctggtttacacggctccgcgagaccaaagggcccctcggtctccttgagcagcctggcactctgcacagaggatccaggaacggtgtcatggagccacattctgcacagacttgatgatgtggagggagctgcctggatcacttcagcgcatcagttgtgatgggagagccaaggcacttgagggcgggattgcgtctggccacctgttgccttccacctgaagggaagatttccccagtgctcacagtgaggatgggactggaaaagcgttggtttcaggaaggtgcaggttctggctcctgcccactgcgaacatgctgatgggccagggcaactctttagtctttgtgagcttcagttttcttatctgtaaatgagaacaataagactgaccccaactgttgctgaggaatgatgtctttgctttcatgtctggtatttcttagagcctcattttacagatgaggaaactgaggctggctgcgtgctcagagggtttgctgaaggcctcacagccgcttagcacagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatattttaattgtttga

SEQ ID NO: 354987 - DNA, 1531 bp, Homo sapiens
caaaattacggctaggtacgaggctggggttacggagccggagcgcagcgcctgcggccgcccgtgccccgccgtcctccttcccgcggccgtgagggagaccgcggctcggccgtagcggagctgcgaggtgccaggaagggctgcgtggcgcgggaacggccgggcagcgccgcctccgcttcttccgggctgtcaaggccgcgggcgggcggggccgcgctgagggccgggcggggagggccgtcggggcccgggtggccgcggggaccgtgttcccgacccgcggccctgagggttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatattttaattgtttga

SEQ ID NO: 354988 - DNA, 1276 bp, Homo sapiens
ggcggcgccgcggaggacggagcggaagtgctcgctgcagcttcccggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatattttaattgtttga

SEQ ID NO: 354989 - DNA, 1180 bp, Homo sapiens
tttctctccagatcgcaggcccagccagcaggcatggggcccccagcctcagtactgatgctttatactttgtgtagttttaagaagaattgtgtctttcaagggagtaagagaaggatgtttctgtggttagggcagtacatgtctgtgagctacatgcaaagggtcctgctgctgctgtgcccagggtagacccctcctttccacagggatgcttctgtttgcggggacggtcggtgcagctgcaaggctggaggcggccggcaggtgcccggtgctggctgcagatgcggcgctaaccttctctccccacttgaaggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatattttaattgtttga

SEQ ID NO: 354990 - DNA, 470 bp, Homo sapiens
ggcggcgccgcggaggacggagcggaagtgctcgctgcagcttcccggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttccgggatcctctagaccaccaa

SEQ ID NO: 354991 - DNA, 1624 bp, Homo sapiens
ctggccctgatccaggaacagggctggcactgccttgcccggctccaagggtgctccacgggctgcccactgattcctcacgagagccttgtggagaaggcatgagaggtgctgttgtcccatttcacagactggaacctgaggcatcctggaatagcctgtcctagtcacactggcagagagtggtagagccaggatctgaaagcaggctgttggagtccaaagttcacgttcttgctcctgccgccctgcctcaggctattcctggcaatgcgttcagtcagggtgcaagctgtgtttggtatacgtgtgtgtttggtatacgtgttgtgtgtgtcagacaagcaggattggctgatggcgttttgagtaggttttctacatgttcagttggagagtgagaagttctgagctttgcctagagaacaccctttggcgggagagctgggtattttctccctgacattactctcatcacctccagtccagtaaaagtgctttaatgggaaacagtctgagtaaaacggggaaacttacaaggagctataggacgaacaatgtgacgggtggctttcagatggcctggctttggcctaaatagggtggccattccaggtgacacattttagtgtagcctctatttaaatatggagttctttcagtggagagtaaaggtgctcctcctctgtgtctggtttacacggctccgcgagaccaaagggcccctcggtctccttgagcagcctggcactctgcacagaggatccaggaacggtgtcatggagccacattctgcacagacttgatgatgtggagggagctgcctggatcacttcagcgcatcagttgtgatgggagagccaaggcacttgagggcgggattgcgtctggccacctgttgccttccacctgaagggaagatttccccagtgctcacagtgaggatgggactggaaaagcgttggtttcaggaaggtgcaggttctggctcctgcccactgcgaacatgctgatgggccagggcaactctttagtctttgtgagcttcagttttcttatctgtaaatgagaacaataagactgaccccaactgttgctgaggaatgatgtctttgctttcatgtctggtatttcttagagcctcattttacagatgaggaaactgaggctggctgcgtgctcagagggtttgctgaaggcctcacagccgcttagcacaggtgggactttaagccaaacttgagaccagagtctgtttctcctcactgccctgccgagggagcagatggggggtggtgggggaggtgaacgtcacccctggcgtcttctctagctcaggggccaggaggcctctcatctttaaagtaggaatgacaaccggcaggccctgggtactgagctgtgctttaccgaagagcggcaggtcctgacgccgtctcctctcaggagtggggtggcggcgtgctcagctgaggagccaggtggcagtcaggcttggcttggcctgcccagaagcagggctgtggcaggaccttggacacgtggcttccactgtttgagacttggtgaaatgggggtcatgatgcccttcacttgagcatctgggaattaagtgggtgaacaa

SEQ ID NO: 354992 - DNA, 729 bp, Homo sapiens
ggcggcgccgcggaggacggagcggaagtgctcgctgcagcttcccggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacaggttggtgggttttttagtagatgagtataaatatttgaaaaagaaacgggactcccagcattttcgggaaggatctgtttgctggtgttcctgatggagaagttacttcgcctcaggctcaaacttcctgaagacagcgttctcttcactgtgaagggccagctgtggagagatcgggctctggggccacacgtggtctatcaaacatatgcgttttctgtttctgttttccttttaccaagctttaaaaatataaaacccagtctcagctcccaggcaggacagatgcggccgtggctgccgttctgctcttgctgtccctctcccagccacccacgtccccggtgctggtagccccacctgccccgtgtcagctcggcggttctgtccttgagggtgagaggctcttgtgtgggctgcgtgtgcattgcttggtgagtgagggacctagagctgcctttgaacgctggagtccgaacctctgtcaggaaaagcttg

SEQ ID NO: 354993 - DNA, 668 bp, Homo sapiens
caaaattacggctaggtacgaggctggggttacggagccggagcgcagcgcctgcggccgcccgtgccccgccgtcctccttcccgcggccgtgagggagaccgcggctcggccgtagcggagctgcgaggtgccaggaagggctgcgtggcgcgggaacggccgggcagcgccgcctccgcttcttccgggctgtcaaggccgcgggcgggcggggccgcgctgagggccgggcggggagggccgtcggggcccgggtggccgcggggaccgtgttcccgacccgcggccctgagggttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatcgcacagccgtgtagggtgtggatttatcagtcctggctagacaagtccacaccctacacggctgtgcgatgggtcgtgacactgggcctgagctttgtctacatgattcgagtgtaccaaccctgcagcaggtaaac

SEQ ID NO: 354994 - DNA, 226 bp, Homo sapiens
agcggttgtgcagtaactgagtctgtgtttctctccccagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgaggg

SEQ ID NO: 354995 - DNA, 1376 bp, Homo sapiens
ggcggcgccgcggaggacggagcggaagtgctcgctgcagcttcccggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatattttaattgtttga

SEQ ID NO: 354996 - DNA, 825 bp, Homo sapiens
caaaattacggctaggtacgaggctggggttacggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgaggga

SEQ ID NO: 354997 - DNA, 1852 bp, Homo sapiens
ggcggcgccgcggaggacggagcggaagtgctcgctgcagcttcccggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatattttaattgtttgagattattttgacacatttctttgatacgtagagtgttttgtttttaatttaaatctgtcctcatgcaaccctccatgaggggcagcgaagtggcaggggagcagactggctttgtaggttcagcactcggccccccactgcgggagaggcggaacccacttgcatgtcagcgtttttgattcgagaaaagaaatactctcaacgttttaccaagtgattttacctccacctttactaaagtctttacctaaaacatggcagtcgctggacacaggaaagcccaccttttgtttggccttttcgaaaggtgacccatattgcacagcagaacatcacagctgtggtcccagatgagacactgacatgcgagtgaaggcctctcctcctgggccccgggctgcgcaggctcctcactctgggcggtgtttcccacattttgctggagttagtttattaaagatgcctacggtgaactc

SEQ ID NO: 354998 - DNA, 1076 bp, Homo sapiens
ggcggcgccgcggaggacggagcggaagtgctcgctgcagcttcccggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcagatatagcaggatctggatagggcaaatcctgaggagagctgtagtaggcctcaagagtgaaaggttcctttctataaaatgtaagaactttagagaaaggagcagcatgatttttggcaaagacttcacagtcacttgacccttcttcagctggagaattccatctcagagatattggatatggt

SEQ ID NO: 354999 - DNA, 1132 bp, Homo sapiens
ggcggcgccgcggaggacggagcggaagtgctcgctgcagcttcccggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatattttaattgtttga

SEQ ID NO: 355000 - DNA, 1511 bp, Homo sapiens
caaaattacggctaggtacgaggctggggttacggagccggagcgcagcgcctgcggccgcccgtgccccgccgtcctccttcccgcggccgtgagggagaccgcggctcggccgtagcggagctgcgaggcataaagcagtcaccttcaacaggtaattgatgggctgtctactatgtaatggacttccaggtggcagggcccagccccgaaccagacaagggacccctcaaggagcttcattctagcaggagaaaattgagaagtaaaccagaaagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatattttaattgtttga

SEQ ID NO: 355001 - DNA, 2453 bp, Homo sapiens
ctggccctgatccaggaacagggctggcactgccttgcccggctccaagggtgctccacgggctgcccactgattcctcacgagagccttgtggagaaggcatgagaggtgctgttgtcccatttcacagactggaacctgaggcatcctggaatagcctgtcctagtcacactggcagagagtggtagagccaggatctgaaagcaggctgttggagtccaaagttcacgttcttgctcctgccgccctgcctcaggctattcctggcaatgcgttcagtcagggtgcaagctgtgtttggtatacgtgtgtgtttggtatacgtgttgtgtgtgtcagacaagcaggattggctgatggcgttttgagtaggttttctacatgttcagttggagagtgagaagttctgagctttgcctagagaacaccctttggcgggagagctgggtattttctccctgacattactctcatcacctccagtccagtaaaagtgctttaatgggaaacagtctgagtaaaacggggaaacttacaaggagctataggacgaacaatgtgacgggtggctttcagatggcctggctttggcctaaatagggtggccattccaggtgacacattttagtgtagcctctatttaaatatggagttctttcagtggagagtaaaggtgctcctcctctgtgtctggtttacacggctccgcgagaccaaagggcccctcggtctccttgagcagcctggcactctgcacagaggatccaggaacggtgtcatggagccacattctgcacagacttgatgatgtggagggagctgcctggatcacttcagcgcatcagttgtgatgggagagccaaggcacttgagggcgggattgcgtctggccacctgttgccttccacctgaagggaagatttccccagtgctcacagtgaggatgggactggaaaagcgttggtttcaggaaggtgcaggttctggctcctgcccactgcgaacatgctgatgggccagggcaactctttagtctttgtgagcttcagttttcttatctgtaaatgagaacaataagactgaccccaactgttgctgaggaatgatgtctttgctttcatgtctggtatttcttagagcctcattttacagatgaggaaactgaggctggctgcgtgctcagagggtttgctgaaggcctcacagccgcttagcacagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatattttaattgtttga

SEQ ID NO: 355002 - DNA, 1593 bp, Homo sapiens
caaaattacggctaggtacgaggctggggttacggagccggagcgcagcgcctgcggccgcccgtgccccgccgtcctccttcccgcggccgtgagggagaccgcggctcggccgtagcggagctgcgaggcataaagcagtcaccttcaacaggtaattgatgggctgtctactatgtaatggacttccaggtggcagggcccagccccgaaccagacaagggacccctcaaggagcttcattctagcaggagaaaattgagaagtaaaccagaaagagcctcattttacagatgaggaaactgaggctggctgcgtgctcagagggtttgctgaaggcctcacagccgcttagcacagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatattttaattgtttga

SEQ ID NO: 355003 - DNA, 1215 bp, Homo sapiens
gaatttcgagcgtcggtatcccgggagtgaggaatcgtcactacagagtttgtcacaagacgttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatattttaattgtttga

SEQ ID NO: 355004 - DNA, 948 bp, Homo sapiens
ggcggcgccgcggaggacggagcggaagtgctcgctgcagcttcccggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttcgctacccaccaaacagaacgaggaattccgccccttcattcgaaggctcccagagtttaaattttgggatgcttctgtttgcggggacggtcggtgcagctgcaaggctggaggcggccggcaggtgcccggtgctggctgcagatgcggcgctaaccttctctccccacttgaaggcatgcggctaccaagggcatccttgtggctatggtctgtactttcttcgacgctttcaacgtcccggtgttctggccgattctggtgatgtacttcatcatgctcttctgtatcacgatgaagaggcaaatcaagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgaggga

SEQ ID NO: 355005 - DNA, 539 bp, Homo sapiens
caaaattacggctaggtacgaggctggggttacggagccggagcgcagcgcctgcggccgcccgtgccccgccgtcctccttcccgcggccgtgagggagaccgcggctcggccgtagcggagctgcgagagcctcattttacagatgaggaaactgaggctggctgcgtgctcagagggtttgctgaaggcctcacagccgcttagcacagttacagaatgtctgaaggggacagtgtgggagaatccgtccatgggaaaccttcggtggtgtacagatttttcacaagacttggacagatttatcagtcctggctagacaagtccacaccctacacggctgtgcgatgggtcgtgacactgggcctgagctttgtctacatgattcgagtttacctgctgcagggttggtacattgtgacctatgccttggggatctaccatctaaatcttttcatagcttttctttctcccaaagtggatccttccttaatggaagactcagatgacggtccttccgggatcctctagaccaccaa

SEQ ID NO: 355006 - DNA, 552 bp, Homo sapiens
caaaattacggctaggtacgaggctggggttacggagccggagcgcagcgcctgcggccgcccgtgccccgccgtcctccttcccgcggccgtgagggagaccgcggctcggccgtagcggagctgcgaggtgccaggaagggctgcgtggcgcgggaacggccgggcagcgccgcctccgcttcttccgggctgtcaaggccgcgggcgggcggggccgcgctgagggccgggcggggagggccgtcggggcccgggtggccgcggggaccgtgttcccgacccgcggccctgaggggtacgggtcgcgcctcggggtcgggcccgggacggggtgctggggggtgcggcggagccctggggcctgcgagggtcgggggagcgggagaggggccgggcgggggctgcagccctcgagccacccgggccgcatctcgtccgcatcccctgcttggcatctgggggaagcgggcagtcgcggcccccacagcgctgcgagttgggctgtattccagagtaatgtgccctgtccccatcctgcgtccaggtcag

SEQ ID NO: 355007 - DNA, 2764 bp, Homo sapiens
ggccccactgccccgcctcctccttttcctagtcagcgtgttgtcacttccggagaaaacagttcccctccgggccggacagtggtagcggcccgacccgttctagagacggagcgggtgaaaccatttttcagaagggggttattccactggaacctcgagggtggatcggagtcacgtggcgcagacgctgtaggtggatccggctacggagagtgcgcaggcgcagtgttcgccctctcgccacgaagtaaacaagtgggagggtctgagagctgcaccacctggggcaagcacgccttgaaacgcccacttccttctccatattgtatactggaattgaagccaaggaggtaccattttgctcgagggcatggcctaagccggtcagctaaggccatgttaatacggggctgtcccatctctctgcggggcgcgacagctggaagagccgaacggataagagaagaggaggtgagaggagctgtacaccacaagaggcactgagggactcaggataacgggatgaagccgtcagtgcccccagaaacgaagcggccccggacgaatttctgagtcaccgtcgcgagaaagcgggctgagccgccattttgaagcctggcaaaccgaagcaagaaatgctgccgtgttggatctttgccagccttcgtgccgaatgggagcaggttggagggagggagagccaatatacactatgggctgattaagcccggttggctgccatgttgttaacgagcaccgatttcctctacttttgtcgaagaagtttattgtgggtcagggacgtcaggtcgcttgccttcgtttactgtggtcatgattgagcatatgaggacggccattattgttgggggcaaatggaaatgctctaggcggggccatttttcttaggggcaagctgtcgtcacccttgtcaactggttcggatgaagcccctgtggccgccatcttgatctcgggcggccccgataagggaggcggagtgtgcggagaggaggcggggcaactgcgcggacgtgacgcaaggcgccgccatgtcttttgagggcggtgacggcgccgggccggccatgctggctacgggcacggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccgccctcttcgcccgacctggaccgcatcgcggcgagcatgcgcgcgctggtgctgcgagaggccgaggacacccaggtcttcggggacctgccacggccgcggcttaacaccagcgacttccagaagctgaagcggaaatattgaagtccagggagggagcgccccgggccgcgtccgccccgtcccacactacgcccccgccccactcccggggcctgctaatctgaggccgatccgggaccggcctccttgcgtctcccattcccaagattgtcccgcctctgccaatccccgccgtccttccagcccacgacctgccgcgccgaggagcggcatctgtcccgtttcccgattgggtctgtcgtctctctccgcctagcgacagattccttctattaagggattggctcgctgagttctaagctctaaatgggtcaactcctttgttttccgcctagcgacaagggatttgctcgcacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccctgaccccctcagggatggccccaaactgtccctgcctctggcaccccctttcattggttccatccatccccacaacagcctgccaatcgaagcccgtccctgcatccaggatggtaccagctcccgcccctcgccccccacctccacaggtgccttaaagggccctcgtccacccaaggtggggggcaggggccctcactctccggccctggtgtgggggagagagtgaggggttgggggatcggcagttgggaggggcgctctgagattaaagagttttacctctgagataaa

SEQ ID NO: 355008 - DNA, 2858 bp, Homo sapiens
ggccccactgccccgcctcctccttttcctagtcagcgtgttgtcacttccggagaaaacagttcccctccgggccggacagtggtagcggcccgacccgttctagagacggagcgggtgaaaccatttttcagaagggggttattccactggaacctcgagggtggatcggagtcacgtggcgcagacgctgtaggtggatccggctacggagagtgcgcaggcgcagtgttcgccctctcgccacgaagtaaacaagtgggagggtctgagagctgcaccacctggggcaagcacgccttgaaacgcccacttccttctccatattgtatactggaattgaagccaaggaggtaccattttgctcgagggcatggcctaagccggtcagctaaggccatgttaatacggggctgtcccatctctctgcggggcgcgacagctggaagagccgaacggataagagaagaggaggtgagaggagctgtacaccacaagaggcactgagggactcaggataacgggatgaagccgtcagtgcccccagaaacgaagcggccccggacgaatttctgagtcaccgtcgcgagaaagcgggctgagccgccattttgaagcctggcaaaccgaagcaagaaatgctgccgtgttggatctttgccagccttcgtgccgaatgggagcaggttggagggagggagagccaatatacactatgggctgattaagcccggttggctgccatgttgttaacgagcaccgatttcctctacttttgtcgaagaagtttattgtgggtcagggacgtcaggtcgcttgccttcgtttactgtggtcatgattgagcatatgaggacggccattattgttgggggcaaatggaaatgctctaggcggggccatttttcttaggggcaagctgtcgtcacccttgtcaactggttcggatgaagcccctgtggccgccatcttgatctcgggcggccccgataagggaggcggagtgtgcggagaggaggcggggcaactgcgcggacgtgacgcaaggcgccgccatgtcttttgagggcggtgacggcgccgggccggccatgctggctacgggcacgtgagtggaggcggcgttgttaaccgcggtgtggggaggatttggccgtcctgaggcagcggggcgctgggagggcgagcggctcacgggagggggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccgccctcttcgcccgacctggaccgcatcgcggcgagcatgcgcgcgctggtgctgcgagaggccgaggacacccaggtcttcggggacctgccacggccgcggcttaacaccagcgacttccagaagctgaagcggaaatattgaagtccagggagggagcgccccgggccgcgtccgccccgtcccacactacgcccccgccccactcccggggcctgctaatctgaggccgatccgggaccggcctccttgcgtctcccattcccaagattgtcccgcctctgccaatccccgccgtccttccagcccacgacctgccgcgccgaggagcggcatctgtcccgtttcccgattgggtctgtcgtctctctccgcctagcgacagattccttctattaagggattggctcgctgagttctaagctctaaatgggtcaactcctttgttttccgcctagcgacaagggatttgctcgcacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccctgaccccctcagggatggccccaaactgtccctgcctctggcaccccctttcattggttccatccatccccacaacagcctgccaatcgaagcccgtccctgcatccaggatggtaccagctcccgcccctcgccccccacctccacaggtgccttaaagggccctcgtccacccaaggtggggggcaggggccctcactctccggccctggtgtgggggagagagtgaggggttgggggatcggcagttgggaggggcgctctgagattaaagagttttacctctgagataaa

SEQ ID NO: 355009 - DNA, 2360 bp, Homo sapiens
ggccccactgccccgcctcctccttttcctagtcagcgtgttgtcacttccggagaaaacagttcccctccgggccggacagtggtagcggcccgacccgttctagagacggagcgggtgaaaccatttttcagaagggggttattccactggaacctcgagggtggatcggagtcacgtggcgcagacgctgtaggtggatccggctacggagagtgcgcaggcgcagtgttcgccctctcgccacgaagtaaacaagtgggagggtctgagagctgcaccacctggggcaagcacgccttgaaacgcccacttccttctccatattgtatactggaattgaagccaaggaggtaccattttgctcgagggcatggcctaagccggtcagctaaggccatgttaatacggggctgtcccatctctctgcggggcgcgacagctggaagagccgaacggataagagaagaggaggtgagaggagctgtacaccacaagaggcactgagggactcaggataacgggatgaagccgtcagtgcccccagaaacgaagcggccccggacgaatttctgagtcaccgtcgcgagaaagcgggctgagccgccattttgaagcctggcaaaccgaagcaagaaatgctgccgtgttggatctttgccagccttcgtgccgaatgggagcaggttggagggagggagagcggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccgccctcttcgcccgacctggaccgcatcgcggcgagcatgcgcgcgctggtgctgcgagaggccgaggacacccaggtcttcggggacctgccacggccgcggcttaacaccagcgacttccagaagctgaagcggaaatattgaagtccagggagggagcgccccgggccgcgtccgccccgtcccacactacgcccccgccccactcccggggcctgctaatctgaggccgatccgggaccggcctccttgcgtctcccattcccaagattgtcccgcctctgccaatccccgccgtccttccagcccacgacctgccgcgccgaggagcggcatctgtcccgtttcccgattgggtctgtcgtctctctccgcctagcgacagattccttctattaagggattggctcgctgagttctaagctctaaatgggtcaactcctttgttttccgcctagcgacaagggatttgctcgcacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccctgaccccctcagggatggccccaaactgtccctgcctctggcaccccctttcattggttccatccatccccacaacagcctgccaatcgaagcccgtccctgcatccaggatggtaccagctcccgcccctcgccccccacctccacaggtgccttaaagggccctcgtccacccaaggtggggggcaggggccctcactctccggccctggtgtgggggagagagtgaggggttgggggatcggcagttgggaggggcgctctgagattaaagagttttacctctgagataaa

SEQ ID NO: 355010 - DNA, 1989 bp, Homo sapiens
ctgcaccataagccgcggctctcacgcgccggcgcttggagaagggcaaagcgggtggagcctaccttcttggagaagaggatttgggtggaatctccagcctcctctacaggagcccagtgcaggaggacgtcattgtcctaggccttcttcaggtcccactgctgaccgccagaccaaactcctacagctgccgcctgcatcccagaccgcctgcatcccgctcggagcgggtccgagccctgctccctcccagcgcaccttttccacgacacggatgacaccagcgatgagagagtctcggtcctgatacttcttagcgctggtgtgcagggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccgccctcttcgcccgacctggaccgcatcgcggcgagcatgcgcgcgctggtgctgcgagaggccgaggacacccaggtcttcggggacctgccacggccgcggcttaacaccagcgacttccagaagctgaagcggaaatattgaagtccagggagggagcgccccgggccgcgtccgccccgtcccacactacgcccccgccccactcccggggcctgctaatctgaggccgatccgggaccggcctccttgcgtctcccattcccaagattgtcccgcctctgccaatccccgccgtccttccagcccacgacctgccgcgccgaggagcggcatctgtcccgtttcccgattgggtctgtcgtctctctccgcctagcgacagattccttctattaagggattggctcgctgagttctaagctctaaatgggtcaactcctttgttttccgcctagcgacaagggatttgctcgcacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccctgaccccctcagggatggccccaaactgtccctgcctctggcaccccctttcattggttccatccatccccacaacagcctgccaatcgaagcccgtccctgcatccaggatggtaccagctcccgcccctcgccccccacctccacaggtgccttaaagggccctcgtccacccaaggtggggggcaggggccctcactctccggccctggtgtgggggagagagtgaggggttgggggatcggcagttgggaggggcgctctgagattaaagagttttacctctgagataaa

SEQ ID NO: 355011 - DNA, 1653 bp, Homo sapiens
acaggaaaagacaatagttcaggtagcgaggctgcgtgtttatccatctctctgcggggcgcgatagctggaagagccgaacggataagagaagaggagggcgcggatggcgtctggggcgccccgtaggacctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccgccctcttcgcccgacctggaccgcatcgcggcgagcatgcgcgcgctggtgctgcgagaggccgaggacacccaggtcttcggggacctgccacggccgcggcttaacaccagcgacttccagaagctgaagcggaaatattgaagtccagggagggagcgccccgggccgcgtccgccccgtcccacactacgcccccgccccactcccggggcctgctaatctgaggccgatccgggaccggcctccttgcgtctcccattcccaagattgtcccgcctctgccaatccccgccgtccttccagcccacgacctgccgcgccgaggagcggcatctgtcccgtttcccgattgggtctgtcgtctctctccgcctagcgacagattccttctattaagggattggctcgctgagttctaagctctaaatgggtcaactcctttgttttccgcctagcgacaagggatttgctcgcacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccctgaccccctcagggatggccccaaactgtccctgcctctggcaccccctttcattggttccatccatccccacaacagcctgccaatcgaagcccgtccctgcatccaggatggtaccagctcccgcccctcgccccccacctccacaggtgccttaaagggccctcgtccacccaaggtggggggcaggggccctcactctccggccctggtgtgggggagagagtgaggggttgggggatcggcagttgggaggggcgctctgagattaaagagttttacctctgagataaa

SEQ ID NO: 355012 - DNA, 2692 bp, Homo sapiens
  misc_feature (2655)..(2655): n is a, c, g, or t
  misc_feature (2687)..(2687): n is a, c, g, or t
ggccccactgccccgcctcctccttttcctagtcagcgtgttgtcacttccggagaaaacagttcccctccgggccggacagtggtagcggcccgacccgttctagagacggagcgggtgaaaccatttttcagaagggggttattccactggaacctcgagggtggatcggagtcacgtggcgcagacgctgtaggtggatccggctacggagagtgcgcaggcgcagtgttcgccctctcgccacgaagtaaacaagtgggagggtctgagagctgcaccacctggggcaagcacgccttgaaacgcccacttccttctccatattgtatactggaattgaagccaaggaggtaccattttgctcgagggcatggcctaagccggtcagctaaggccatgttaatacggggctgtcccatctctctgcggggcgcgacagctggaagagccgaacggataagagaagaggaggtgagaggagctgtacaccacaagaggcactgagggactcaggataacgggatgaagccgtcagtgcccccagaaacgaagcggccccggacgaatttctgagtcaccgtcgcgagaaagcgggctgagccgccattttgaagcctggcaaaccgaagcaagaaatgctgccgtgttggatctttgccagccttcgtgccgaatgggagcaggttggagggagggagagccaatatacactatgggctgattaagcccggttggctgccatgttgttaacgagcaccgatttcctctacttttgtcgaagaagtttattgtgggtcagggacgtcaggtcgcttgccttcgtttactgtggtcatgattgagcatatgaggacggccattattgttgggggcaaatggaaatgctctaggcggggccatttttcttaggggcaagctgtcgtcacccttgtcaactggttcggatgaagcccctgtggccgccatcttgatctcgggcggccccgataagggaggcggagtgtgcggagaggaggcggggcaactgcgcggacgtgacgcaaggcgccgccatgtcttttgagggcggtgacggcgccgggccggccatgctggctacgggcacggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccgccctcttcgcccgacctggaccgcatcgcggcgagcatgcgcgcgctggtgctgcgagaggccgaggacacccaggtcttcggggacctgccacggccgcggcttaacaccagcgacttccagaagctgaagcggaaatattgaagtccagggagggagcgccccgggccgcgtccgccccgtcccacactacgcccccgccccactcccggggcctgctaatctgaggccgatccgggaccggcctccttgcgtctcccattcccaagattgtcccgcctctgccaatccccgccgtccttccagcccacgacctgccgcgccgaggagcggcatctgtcccgtttcccgattgggtctgtcgtctctctccgcctagcgacagattccttctattaagggattggctcgctgagttctaagctctaaatgggtcaactcctttgttttccgcctagcgacaagggatttgctcgcacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccctgaccccctcagggatggccccaaactgtccctgcctctggcaccccctttcattggttccatccatccccacaacagcctgccaatcgaagcccgtccctgcatccaggatggtaccagctcccgcccctcgccccactcaaagtgcttaaaggccttgtcaccaagtgggggaaggcctaatntcggcctgttggggaaaattaggttgggatgnattga

SEQ ID NO: 355013 - DNA, 2016 bp, Homo sapiens
ggccccactgccccgcctcctccttttcctagtcagcgtgttgtcacttccggagaaaacagttcccctccgggccggacagtggtagcggcccgacccgttctagagacggagcgggtgaaaccatttttcagaagggggttattccactggaacctcgagggtggatcggagtcacgtggcgcagacgctgtaggtggatccggctacggagagtgcgcaggcgcagtgttcgccctctcgccacgaagtaaacaagtgggagggtctgagagctgcaccacctggggcaagcacgccttgaaacgcccacttccttctccatattgtatactggaattgaagccaaggaggtaccattttgctcgagggcatggcctaagccggtcagctaaggccatgttaatacggggctgtcccatctctctgcggggcgcgacagctggaagagccgaacggataagagaagaggaggtgagaggagctgtacaccacaagaggcactgagggactcaggataacgggatgaagccgtcagtgcccccagaaacgaagcggccccggacgaatttctgagtcaccgtcgcgagaaagcgggctgagccgccattttgaagcctggcaaaccgaagcaagaaatgctgccgtgttggatctttgccagccttcgtgccgaatgggagcaggttggagggagggagagccaatatacactatgggctgattaagcccggttggctgccatgttgttaacgagcaccgatttcctctacttttgtcgaagaagtttattgtgggtcagggacgtcaggtcgcttgccttcgtttactgtggtcatgattgagcatatgaggacggccattattgttgggggcaaatggaaatgctctaggcggggccatttttcttaggggcaagctgtcgtcacccttgtcaactggttcggatgaagcccctgtggccgccatcttgatctcgggcggccccgataagggaggcggagtgtgcggagaggaggcggggcaactgcgcggacgtgacgcaaggcgccgccatgtcttttgagggcggtgacggcgccgggccggccatgctggctacgggcacggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccggtgaggggcaaatgtggggaggtagggagggcagctggaagggctctgagccgcctcctccaggaagccctccagcatggatgctgctttccacccataagctaactgaatcctcccctcaacctcaagaggcgagttcttggacacgagccttgcagttttaacaattgcagccttaccatgtgtcctagtgccttatagagaaggcctctcctttccaggagcgtctctatttatagaacacctgctctgggcaaggcacaggtgttttggc

SEQ ID NO: 355014 - DNA, 1660 bp, Homo sapiens
  misc_feature (30)..(30): n is a, c, g, or t
  misc_feature (37)..(37): n is a, c, g, or t
  misc_feature (41)..(41): n is a, c, g, or t
aacaccatcacacagccccaacacctacgnctaggtngagnctgggtttgtcccatctctctgcggggcgcgacagctggaagagccgaacggataagagaagaggagggcgcggatggcgtcggggcgccccgaggacctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccgccctcttcgcccgacctggaccgcatcgcggcgagcatgcgcgcgctggtgctgcgagaggccgaggacacccaggtcttcggggacctgccacggccgcggcttaacaccagcgacttccagaagctgaagcggaaatattgaagtccagggagggagcgccccgggccgcgtccgccccgtcccacactacgcccccgccccactcccggggcctgctaatctgaggccgatccgggaccggcctccttgcgtctcccattcccaagattgtcccgcctctgccaatccccgccgtccttccagcccacgacctgccgcgccgaggagcggcatctgtcccgtttcccgattgggtctgtcgtctctctccgcctagcgacagattccttctattaagggattggctcgctgagttctaagctctaaatgggtcaactcctttgttttccgcctagcgacaagggatttgctcgcacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccctgaccccctcagggatggccccaaactgtccctgcctctggcaccccctttcattggttccatccatccccacaacagcctgccaatcgaagcccgtccctgcatccaggatggtaccagctcccgcccctcgccccccacctccacaggtgccttaaagggccctcgtccacccaaggtggggggcaggggccctcactctccggccctggtgtgggggagagagtgaggggttgggggatcggcagttgggaggggcgctctgagattaaagagttttacctctgagataaa

SEQ ID NO: 355015 - DNA, 2130 bp, Homo sapiens
ggccccactgccccgcctcctccttttcctagtcagcgtgttgtcacttccggagaaaacagttcccctccgggccggacagtggtagcggcccgacccgttctagagacggagcgggtgaaaccatttttcagaagggggttattccactggaacctcgagggtggatcggagtcacgtggcgcagacgctgtaggtggatccggctacggagagtgcgcaggcgcagtgttcgccctctcgccacgaagtaaacaagtgggagggtctgagagctgcaccacctggggcaagcacgccttgaaacgcccacttccttctccatattgtatactggaattgaagccaaggaggtaccattttgctcgagggcatggcctaagccggtcagctaaggccatgttaatacggggctgtcccatctctctgcggggcgcgacagctggaagagccgaacggataagagaagaggagggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccgccctcttcgcccgacctggaccgcatcgcggcgagcatgcgcgcgctggtgctgcgagaggccgaggacacccaggtcttcggggacctgccacggccgcggcttaacaccagcgacttccagaagctgaagcggaaatattgaagtccagggagggagcgccccgggccgcgtccgccccgtcccacactacgcccccgccccactcccggggcctgctaatctgaggccgatccgggaccggcctccttgcgtctcccattcccaagattgtcccgcctctgccaatccccgccgtccttccagcccacgacctgccgcgccgaggagcggcatctgtcccgtttcccgattgggtctgtcgtctctctccgcctagcgacagattccttctattaagggattggctcgctgagttctaagctctaaatgggtcaactcctttgttttccgcctagcgacaagggatttgctcgcacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccctgaccccctcagggatggccccaaactgtccctgcctctggcaccccctttcattggttccatccatccccacaacagcctgccaatcgaagcccgtccctgcatccaggatggtaccagctcccgcccctcgccccccacctccacaggtgccttaaagggccctcgtccacccaaggtggggggcaggggccctcactctccggccctggtgtgggggagagagtgaggggttgggggatcggcagttgggaggggcgctctgagattaaagagttttacctctgagataaa

SEQ ID NO: 355016 - DNA, 3273 bp, Homo sapiens
ggccccactgccccgcctcctccttttcctagtcagcgtgttgtcacttccggagaaaacagttcccctccgggccggacagtggtagcggcccgacccgttctagagacggagcgggtgaaaccatttttcagaagggggttattccactggaacctcgagggtggatcggagtcacgtggcgcagacgctgtaggtggatccggctacggagagtgcgcaggcgcagtgttcgccctctcgccacgaagtaaacaagtgggagggtctgagagctgcaccacctggggcaagcacgccttgaaacgcccacttccttctccatattgtatactggaattgaagccaaggaggtaccattttgctcgagggcatggcctaagccggtcagctaaggccatgttaatacggggctgtcccatctctctgcggggcgcgacagctggaagagccgaacggataagagaagaggaggtgagaggagctgtacaccacaagaggcactgagggactcaggataacgggatgaagccgtcagtgcccccagaaacgaagcggccccggacgaatttctgagtcaccgtcgcgagaaagcgggctgagccgccattttgaagcctggcaaaccgaagcaagaaatgctgccgtgttggatctttgccagccttcgtgccgaatgggagcaggttggagggagggagagccaatatacactatgggctgattaagcccggttggctgccatgttgttaacgagcaccgatttcctctacttttgtcgaagaagtttattgtgggtcagggacgtcaggtcgcttgccttcgtttactgtggtcatgattgagcatatgaggacggccattattgttgggggcaaatggaaatgctctaggcggggccatttttcttaggggcaagctgtcgtcacccttgtcaactggttcggatgaagcccctgtggccgccatcttgatctcgggcggccccgataagggaggcggagtgtgcggagaggaggcggggcaactgcgcggacgtgacgcaaggcgccgccatgtcttttgagggcggtgacggcgccgggccggccatgctggctacgggcacggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccgccctcttcgcccgacctggaccgcatcgcggcgagcatgcgcgcgctggtgctgcgagaggccgaggacacccaggtcttcggggacctgccacggccgcggcttaacaccagcgacttccagaagctgaagcggaaatattgaagtccagggagggagcgccccgggccgcgtccgccccgtcccacactacgcccccgccccactcccggggcctgctaatctgaggccgatccgggaccggcctccttgcgtctcccattcccaagattgtcccgcctctgccaatccccgccgtccttccagcccacgacctgccgcgccgaggagcggcatctgtcccgtttcccgattgggtctgtcgtctctctccgcctagcgacagattccttctattaagggattggctcgctgagttctaagctctaaatgggtcaactcctttgttttccgcctagcgacaagggatttgctcgcacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccctgaccccctcagggatggccccaaactgtccctgcctctggcaccccctttcattggttccatccatccccacaacagcctgccaatcgaagcccgtccctgcatccaggatggtaccagctcccgcccctcgccccccacctccacaggtgccttaaagggccctcgtccacccaaggtggggggcaggggccctcactctccggccctggtgtgggggagagagtgaggggttgggggatcggcagttgggaggggcgctctgagattaaagagttttacctctgagataaaaaaaaaaaaaaaaaaaaaaaaaaaaaaaaaaaaaacaaaaaaaaaaggggggggcccccaaaaaatctcccccgggggggcccaaataagcccccccccggtgtttttgtgtgaaaagagggggcccccctatagatggagcgtgcattttattatacgcagaaagcaggaggagcccgggattttaaacaacgtttggagagtggtggaaaaccacgccgccatacagtggaaaaaatttgtggtaaaaggagaaacctaattgctggcggggggggggagcacaaatattggggtgggacaaaatatcctccacaacgagaagataatttaaaagccgctctctgaaagggggcaaaaatatataagaaattgttaaggcggttactaaaagtggggtgaaaaacaaacctggggtcgatttatgtttgtggtggggtgaagaaaaaatgtgtgttaataacgggtattggtgcattgatgaaaaaacaatttttttacccgggggg

SEQ ID NO: 355017 - DNA, 2765 bp, Homo sapiens
ggccccactgccccgcctcctccttttcctagtcagcgtgttgtcacttccggagaaaacagttcccctccgggccggacagtggtagcggcccgacccgttctagagacggagcgggtgaaaccatttttcagaagggggttattccactggaacctcgagggtggatcggagtcacgtggcgcagacgctgtaggtggatccggctacggagagtgcgcaggcgcagtgttcgccctctcgccacgaagtaaacaagtgggagggtctgagagctgcaccacctggggcaagcacgccttgaaacgcccacttccttctccatattgtatactggaattgaagccaaggaggtaccattttgctcgagggcatggcctaagccggtcagctaaggccatgttaatacggggctgtcccatctctctgcggggcgcgacagctggaagagccgaacggataagagaagaggaggtgagaggagctgtacaccacaagaggcactgagggactcaggataacgggatgaagccgtcagtgcccccagaaacgaagcggccccggacgaatttctgagtcaccgtcgcgagaaagcgggctgagccgccattttgaagcctggcaaaccgaagcaagaaatgctgccgtgttggatctttgccagccttcgtgccgaatgggagcaggttggagggagggagagccaatatacactatgggctgattaagcccggttggctgccatgttgttaacgagcaccgatttcctctacttttgtcgaagaagtttattgtgggtcagggacgtcaggtcgcttgccttcgtttactgtggtcatgattgagcatatgaggacggccattattgttgggggcaaatggaaatgctctaggcggggccatttttcttaggggcaagctgtcgtcacccttgtcaactggttcggatgaagcccctgtggccgccatcttgatctcgggcggccccgataagggaggcggagtgtgcggagaggaggcggggcaactgcgcggacgtgacgcaaggcgccgccatgtcttttgagggcggtgacggcgccgggccggccatgctggctacgggcacggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccgccctcttcgcccgacctggaccgcatcgcggcgagcatgcgcgcgctggtgctgcgagaggccgaggacacccaggtcttcggggacctgccacggccgcggcttaacaccagcgacttccagaagctgaagcggaaatattgaagtccagggagggagcgccccgggccgcgtccgccccgtcccacactacgcccccgccccactcccggggcctgctaatctgaggccgatccgggaccggcctccttgcgtctcccattcccaagattgtcccgcctctgccaatccccgccgtccttccagcccacgacctgccgcgccgaggagcggcatctgtcccgtttcccgattgggtctgtcgtctctctccgcctagcgacagattccttctattaagggattggctcgctgagttctaagctctaaatgggtcaactcctttgttttccgcctagcgacaagggatttgctcgcacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccctgaccccctcagggatggccccaaactgtccctgcctctggcaccccctttcattggttccatccatccccacaacagccaaccgtggaactagtatgccaaccgtggactagtagccaaccgtggactagtagccaaccgtggacatagtagccagaccgtggactagtagccaaccgtggactagtagccaaccgtggactagtactagccaaccgtggactagtactagccaaccgtggactagtactagccaaccgtggactagactagccaaccgtgagtagtacacaca

SEQ ID NO: 355018 - DNA, 379 bp, Homo sapiens
ggctctttgtgatggatgaggacgccaccctccaggaccttccccccttctgtgagtcagaccccgagagtacagatggtgagtgtcccaggctgttcccctcccgacctgggggcaggcacacggccgacacaaaggcagggacagaagctgaagtccaccctctctttcagatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccggtgaggggcaaatgtggggaggtagggagggcagct

SEQ ID NO: 355019 - DNA, 725 bp, Homo sapiens
aacatgtgagaagtacttagaatactgcttggcacatgtgcaccaagtcccctccaaggagagaccctgggtaatgatgatctttggtgtcaactaagattcttaagaactggatcctcgtgattcctatgtgacctgaaggacggatgaaattcaccaaagtctctaccacagacattctcagatggtcctaataaaaagaagaaacccaaaccagaactggtggtccacattgtgagagttgctgaatatcatcacaaagcaataattatccaacagcatgcttggtggctcaacattctgaaaggcaaatgtcaagggcacatagtctcaaccatgttgctgatgggagctcatgttttttgtgttgggtggtcttgtgttctgcctggtggtctttcttctgcctgctatgacagcactaatgatttcatgtacacagtattcacttgtctccctttagtagtgcatgacaagtcataaaagacagactgcccagaaatgacactgcagtattccagacattttctctcttggtggtgacagttccaaatcaagctggctcagtgcttttaagtcaaagcatttgtcgaagtggcagtttgaaacacagccttagatctggagaatcaaactaggctcttctcacctctcccatcattgctggtaataaatattcaactgctggaccacagctagcagattatgatagatgacacagaata

SEQ ID NO: 355020 - DNA, 618 bp, Homo sapiens
aacatgtgagaagtacttagaatactgcttggcacatgtgcaccaagtcccctccaaggagagaccctgggtaatgatgatctttggtgtcaactaagattcttaagaactggatcctcgtgattcctatgtgacctgaagatgtggccagtccaccaccaaagcaaggaaggagatatgagaaggaagtttcgtctcctacccagtgcatcattactggcaacagtgagaagcagagctgggaatttgagaagcaaaccaatgccttctgcttctcatcattattcctgacaacagacagaaaagaggcaaaccttcaccttctgtggtcgcttctgatactcaaccgggaacctcattctcagtagctacagatttccctaatcactcatcttaacttgacactgcgttctagtgcctttcgtgagaagggtcttgggaggccataaacctatgttgctgggaaaagaatgtactgcaataaagagagcaggagaggagctgcagatttccagctctcacagcttgttcacttgtggagactaggctgcaatgtgctcttgaaatcattggggtgggccttgtttctgaggaaataaagaggccccagaacctccc

SEQ ID NO: 355021 - DNA, 5426 bp, Homo sapiens
aaggaatcaagcccccaagatggcggcagcggcggaggagcggatggcagaggaaggaggcggcggccaaggcgacggcggttcctctttggcctccggctctacccagcgacagcctccaccgcccgcgccacagcacccgcagccggggtcccaggcgctcccagcccccgcgctggctccggaccagctgcctcaaaacaacacgcttgtggcgctgcccatcgtagccatcgagaacatcctcagctttatgtcctacgacgaaattagccagctccgcctggtttgtaaaagaatggacttggtctgccagagaatgttgaatcagggatttctgaaagtggagaggtaccataatctatgtcagaaacaagttaaagcacaactcccaaggagagagtcagaaaggagaaaccattcattagctcgtcatgcagacattcttgctgctgttgaaacaaggctgtcactattaaatatgactttcatgaaatatgtggattccaatctctgttgcttcatcccaggaaaggtgattgatgagatttatcgtgtgttgagatatgtcaattctaccagagcccctcaacgagctcatgaagtacttcaagaattaagggatatatcctctatggcaatggagtactttgatgaaaagattgttccaattttaaagaggaaattaccaggatcagatgtttctggaagactcatgggctctcctccagttccaggaccgtctgcagccctaacaacaatgcagctcttctccaagcaaaatccttcaagacaagaggttaccaaactccagcagcaggttaaaacaaatggtgctggcgtgactgttctcaggcgtgaaatttctgagcttcgcaccaaagtgcaagaacagcaaaaacagcttcaagaccaggaccagaaactgctagagcagacccagatcataggtgaacaaaatgcacggttggcagagctagaacgcaaactacgagaagtaatggaaagtgctgtaggaaattcctcagggtccgggcagaatgaggagtctcctcggaaacgaaaaaaggccacggaagccatagactctcttaggaaatctaaacgtcttcggaatagaaagtaaattggaatgtggttctagttccagaggaagacacagcttagtagcttaagcagttatgcatatcaggatactgtgagcaacatggtgtcccttaagcttctaggctttcagaacacaacttaaacttgaactcttatggttgggacattcttttcctgcttctcctgattgaactgatgcacagaatctttttactttgcaatagatttgtactaaccagacctgttctatcatgttttgaggagttaacttttttctgtgcagataatgttgaaagtaagttaatttgtttctgcatatatgcacatacatacgtaaggatcttaaacccagtcttgacagactagaagttaagtttaatacagaaaatgtcctgttcacttgaaagaaaagacctactttttaaatggacactatcttggttcttttttttttaagtcatctttttgttataagtgacctttgtctggaatgtctgaaaagtagttaatgctttttggtattgaagtaatgggtaactaaaatggacttccatagtattgactgtagaaggagcctctacaatattgactatatatttttataaactactggcaaggaacttacccagctgttatacatgttttcagttctctttgggggccatgtcctacatttgcatggatggatgcatgcattgcctagtcaactcacttaaaaagctcttgcactggtattgatcttgaacctctatacttctccactttttagagcggcgtcttagtttatttaaacgcttaacatcttccaccgcaacagcttgcctctagagggggaattgttcatccatttgtcctccagttttataggaacaagagactattaaagcccattgctttatctgctctctgtagggttcaggtacactggctaaggcagaaccccaaatttcaaggctctttctatcaatattggacctctgggagctaatactcctctttgctcaccaccatgtgatcattgatcagatgtggtgagtgagtaggggactcgacttgcgggatgcagttttgccattgcagcaaagttcattgaggaaaattgtaccatgaaaaagcattttgattatttcatttctggaggatgaccttgagggaagctttttaatattagtttcaagctttccttaccctacaactttaaacaaaagctttaattttgtttgcactcctattttgagcttgtaactggaaaagcatgtcttgcactgttcaacctcctgagtggtcgctttaacaacctccaaattgtgtacagtggttattttccccagttgtatagttttgagacattcaattatcactgtcttagttgtattttaatttactaaattatgtagctatttgactgttaagttcttttaaacaactgtttccttgggcttcagttatttaaagtaaatttaggtgtaatatagaaaactgtccctttccaggtgggagcttaacacctgtataaaacctaaggttttagtaagtaccttagttgaataaaagcacaaggttatcaccttttttatccgtccaccgtgacatggttatgcatcctttagattaacctcaccaaatgaagctttttctatccatttttaatattgtccttacataatattgtccttagattttgatcaattctatgtctgactttgaaattccatttacaatgtagtatgttttcaatgaaaaaccataaagtaacatccaagtgtttcatggtttgttgggaaggtaattttaaaataaaacaatttccaaaaaacatttgtcagccaaggtcatccataaaagtccccgtctggaactcattttctcagcacttctcatttttataatcatagtatttagccatattagcatatctttagaggaggcctggtggaatacccggggcctctactagtctgtttttccggtcataggaagacttttttttttacgtatcaaagtatgtgtttacagatttacagagtgtgatccgtatgcatcaaagggatacagccccagactgtttctttaatggtcattcatgaactattaaaaatttcctgaatttctttttaaactacatctagatagcctaaacatctatgtagtcttccattagttaacatgtgtatagggctttcataataagtagtcacactgttacaaggtaaattttctattacaaaatccaaatttctattgcatacacttataatcatctattcataaagctaattcattgtacttgttaatgcatgaatgttccatgcagtaggagaataaagcactacagttcggttgttcaaatcttaaatcttaggctatttagctaaaacatgttaggatattgccttcaccacttgttaggacagttatttgatagccattatgcttacctatggatagcataatggtatttaaggttcaacaaaccgcagattattatcatcagctagaactgacatatgttacaagaaaactgtaaattaacctcctgagagaaccattctgccctgcattttaagtcaggtatttaaatactgcgtgttgttaatattgcgttgtcttagtgcaacatttcttaaagtattcccgttatcttccttggctgtttttcagaggagacgtctccatgttaatgggtccttcccacatagaaatgtattctggtacagcgctgcacacatggatagcaatgtgaaaaggcatgcctaagagacagaaacggctgaccttaccccaccccagccggatcctctgcttatctcccacatgcacttggcttaactggttttcacagattctgaggttatagaacctgttgtttttcaaactcctgtacagagcctggaaataatggagcaaacgcaaatgtattgagagtcattatactttaaaatagttttaaagactattggggtaccatcaggtcaaaagccactgatttgggaagcaatttttttgcaaaacactttttttggagtactgaactttacaggggcttgccttaatctctatttagtagtttcaagatgtatgcgcaattattctacgtgttaaaaatgttaaaatattctatgtagccccaaaggtgggtaaaacagtataagtaatgcctaaattaataagctaaaaggtgtcactacagctggatttttgagagaaaatggacataaaactaggctatgtgtaataaaaataatggcaccttaagattgcactattttacgcattattttatatgccatttcatagcctgcactttaatctccaaagaaacgatgtatgatgtcccacttgttccttattcttaataaactttttcctgagacagggcacttaattctattttactgtactgaattagtttcttggaggtagattcatttcttgagttctctgtttccttagccataatattttctaggatccgggaactccctgtattgtctatttccaacattatataattttaatttaatgtaatgtaaatctcatacttggtgatcagcacattcttatatcctgctctagcaatgagtacccatttgttacacttaccaaactctctaaaaacatatactgtgagtaagatttgaagccaggaataaaaggcagtctgaaagaaaacgtcctatacgatgcagttgtttggaaatggctgatttctgatatgaaacccaacttgatacactgtttggttctttgacttgggatctatctgaattgctttcactagtacacaaaaggttaagttaaaactactttaaacttgtatagcctgccatctgaggtgaattattttcaaaaaatactaaatctatgaactgagactagcaattagttggctgctccctaccatgattttacttttaatagcaatacagttatattggtgataaatatgacaggcttaagtactgctgtccttttgcatcttcctaagcatcttggttaaatttctgaagtttaaaaattagatccagatttcttctgttgtgtctgaagagaaccatgacatttagaagtatattggtaatctattaggtccattggcaaagtatattggtccatattcaaacctattccaaaaggttagaagtgtttaagattcctttattgtggtaccatgtctgtttacctatgcttatgagcaacaataaattactagtttaccttctggaattttaattgttataaccgaatcaattattggaaagtgaaaaacacctcccggtcacacaacagggtacgtaaataaatgtgttgttaccagt

SEQ ID NO: 355022 - DNA, 572 bp, Homo sapiens
ccccccggtagatttactgagcataaccttggggagcaggtcaggaggaccctttggcatggtgggtaaaactgcccgcaccttagccccaagctctaccagtaggcattattctttcatcttttgtgtaaaacaccatttttattatttagttaattaattttctgggcgacagagtgagacttcgtctccaaaaaaaaagatatatacagcaaactgaggaataatagtgggatacagagagctttaagccatcagttatgagtctcagttgtctcttattaatttggttattgatttttgttgttctttttttctccttgaaggtttgtaaaagaatggacttggtctgccagagaatgttgaatcagggatttctgaaagtggagaggtaccataatctatgtcagaaacaagttaaagcacaactcccaaggtatgttgtgggtggcaatgacaatgatgtacagttggttttgtttgttgcttgacttctttttttcagtctcatggtttacatattgcttcccagtttttatagcaaggcaatctacctgggcggatccttagag

SEQ ID NO: 355023 - DNA, 5338 bp, Homo sapiens
aaggaatcaagcccccaagatggcggcagcggcggaggagcggatggcagaggaaggaggcggcggccaaggcgacggcggttcctctttggcctccggctctacccagcgacagcctccaccgcccgcgccacagcacccgcagccggggtcccaggcgctcccagcccccgcgctggctccggaccagctgcctcaaaacaacacgcttgtggcgctgcccatcgtagccatcgagaacatcctcagctttatgtcctacgacgaaattagccagctccgcctggtttgtaaaagaatggacttggtctgccagagaatgttgaatcagggatttctgaaagtggagaggtaccataatctatgtcagaaacaagttaaagcacaactcccaaggagagagtcagaaaggagaaaccattcattagctcgtcatgcagacattcttgctgctgttgaaacaaggctgtcactattaaatatgactttcatgaaatatgtggattccaatctctgttgcttcatcccaggaaaggtgattgatgagatttatcgtgtgttgagatatgtcaattctaccagagcccctcaacgagctcatgaagtacttcaagaattaagggatatatcctctatggcaatggagtactttgatgaaaagattgttccaattttaaagaggaaattaccaggatcagatgtttctggaagactcatgggctctcctccagttccaggaccgtctgcagccctaacaacaatgcagctcttctccaagcaaaatccttcaagacaagaggttaccaaactccagcagcaggttaaaacaaatggtgctggcgtgactgttctcaggcgtgaaatttctgagcttcgcaccaaagtgcaagaacagcaaaaacagcttcaagaccaggaccagaaactgctagagcagacccagatcataggtgaacaaaatgcacggttggcagagctagaacgcaaactacgagaagtaatggaaagtgctgtaggaaattcctcagggtccgggcagaatgaggagtctcctcggaaacgaaaaaaggccacggaagccatagactctcttaggaaatctaaacgtcttcggaatagaaagtaaattggaatgtggttctagttccagaggaagacacagcttagtagcttaagcagttatgcatatcaggatactgtgagcaacatggtgtcccttaagcttctaggctttcagaacacaacttaaacttgaactcttatggttgggacattcttttcctgcttctcctgattgaactgatgcacagaatctttttactttgcaatagatttgtactaaccagacctgttctatcatgttttgaggagttaacttttttctgtgcagataatgttgaaagtaagttaatttgtttctgcatatatgcacatacatacgtaaggatcttaaacccagtcttgacagactagaagttaagtttaatacagaaaatgtcctgttcacttgaaagaaaagacctactttttaaatggacactatcttggttcttttttttttaagtcatctttttgttataagtgacctttgtctggaatgtctgaaaagtagttaatgctttttggtattgaagtaatgggtaactaaaatggacttccatagtattgactgtagaaggagcctctacaatattgactatatatttttataaactactggcaaggaacttacccagctgttatacatgttttcagttctctttgggggccatgtcctacatttgcatggatggatgcatgcattgcctagtcaactcacttaaaaagctcttgcactggtattgatcttgaacctctatacttctccactttttagagcggcgtcttagtttatttaaacgcttaacatcttccaccgcaacagcttgcctctagagggggaattgttcatccatttgtcctccagttttataggaacaagagactattaaagcccattgctttatctgctctctgtagggttcaggtacactggctaaggcagaaccccaaatttcaaggctctttctatcaatattggacctctgggagctaatactcctctttgctcaccaccatgtgatcattgatcagatgtggtgagtgagtaggggactcgacttgcgggatgcagttttgccattgcagcaaagttcattgaggaaaattgtaccatgaaaaagcattttgattatttcatttctggaggatgaccttgagggaagctttttaatattagtttcaagctttccttaccctacaactttaaacaaaagctttaattttgtttgcactcctattttgagcttgtaactggaaaagcatgtcttgcactgttcaacctcctgagtggtcgctttaacaacctccaaattgtgtacagtggttattttccccagttgtatagttttgagacattcaattatcactgtcttagttgtattttaatttactaaattatgtagctatttgactgttaagttcttttaaacaactgtttccttgggcttcagttatttaaagtaaatttaggtgtaatatagaaaactgtccctttccaggtgggagcttaacacctgtataaaacctaaggttttagtaagtaccttagttgaataaaagcacaaggttatcaccttttttatccgtccaccgtgacatggttatgcatcctttagattaacctcaccaaatgaagctttttctatccatttttaatattgtccttacataatattgtccttagattttgatcaattctatgtctgactttgaaattccatttacaatgtagtatgttttcaatgaaaaaccataaagtaacatccaagtgtttcatggtttgttgggaaggtaattttaaaataaaacaatttccaaaaaacatttgtcagccaaggtcatccataaaagtccccgtctggaactcattttctcagcacttctcatttttataatcatagtatttagccatattagcatatctttagaggaggcctggtggaatacccggggcctctactagtctgtttttccggtcataggaagacttttttttttacgtatcaaagtatgtgtttacagatttacagagtgtgatccgtatgcatcaaagggatacagccccagactgtttctttaatggtcattcatgaactattaaaaatttcctgaatttctttttaaactacatctagatagcctaaacatctatgtagtcttccattagttaacatgtgtatagggctttcataataagtagtcacactgttacaaggtaaattttctattacaaaatccaaatttctattgcatacacttataatcatctattcataaagctaattcattgtacttgttaatgcatgaatgttccatgcagtaggagaataaagcactacagttcggttgttcaaatcttaaatcttaggctatttagctaaaacatgttaggatattgccttcaccacttgttaggacagttatttgatagccattatgcttacctatggatagcataatggtatttaaggttcaacaaaccgcagattattatcatcagctagaactgacatatgttacaagaaaactgtaaattaacctcctgagagaaccattctgccctgcattttaagtcaggtatttaaatactgcgtgttgttaatattgcgttgtcttagtgcaacatttcttaaagtattcccgttatcttccttggctgtttttcagaggagacgtctccatgttaatgggtccttcccacatagaaatgtattctggtacagcgctgcacacatggatagcaatgtgaaaaggcatgcctaagagacagaaacggctgaccttaccccaccccagccggatcctctgcttatctcccacatgcacttggcttaactggttttcacagattctgaggttatagaacctgttgtttttcaaactcctgtacagagcctggaaataatggagcaaacgcaaatgtattgagagtcattatactttaaaatagttttaaagactattggggtaccatcaggtcaaaagccactgatttgggaagcaatttttttgcaaaacactttttttggagtactgaactttacaggggcttgccttaatctctatttagtagtttcaagatgtatgcgcaattattctacgtgttaaaaatgttaaaatattctatgtagccccaaaggtgggtaaaacagtataagtaatgcctaaattaataagctaaaaggtgtcactacagctggatttttgagagaaaatggacataaaactaggctatgtgtaataaaaataatggcaccttaagattgcactattttacgcattattttatatgccatttcatagcctgcactttaatctccaaagaaacgatgtatgatgtcccacttgttccttattcttaataaactttttcctgagacagggcacttaattctattttactgtactgaattagtttcttggaggtagattcatttcttgagttctctgtttccttagccataatattttctaggatccgggaactccctgtattgtctatttccaacattatataattttaatttaatgtaatgtaaatctcatacttggtgatcagcacattcttatatcctgctctagcaatgagtacccatttgttacacttaccaaactctctaaaaacatatactgtgagtaagatttgaagccaggaataaaaggcagtctgaaagaaaacgtcctatacgatgcagttgtttggaaatggctgatttctgatatgaaacccaacttgatacactgtttggttctttgacttgggatctatctgaattgctttcactagtacacaaaaggttaagttaaaactactttaaacttgtatagcctgccatctgaggtgaattattttcaaaaaatactaaatctatgaactgagactagcaattagttggctgctccctaccatgattttacttttaatagcaatacagttatattggtgataaatatgacaggcttaagtactgctgtccttttgcatcttcctaagcatcttggttaaatttctgaagtttaaaaattagatccagatttcttctgttgtgtctgaagagaaccatgacatttagaagtatattggtaatctattaggtccattggcaaagtatattggtccatattcaaacctattccaaaaggttagaagtgtttaagattcctttattgtggtaccatgtctgtttacctatgcttatgagcaacaataaattactagtttaccttctggaatttt

SEQ ID NO: 355024 - DNA, 2520 bp, Homo sapiens
ctagagttcccttcggatacttgagaagcaatgtcatccataaaagtccccgtctggaactcattttctcagcacttctcatttttataatcatagtatttagccatattagcatatctttagaggaggcctggtggaatacccggggcctctactagtctgtttttccggtcataggaagacttttttttttacgtatcaaagtatgtgtttacagatttacagagtgtgatccgtatgcatcaaagggatacagccccagactgtttctttaatggtcattcatgaactattaaaaatttcctgaatttctttttaaactacatctagatagcctaaacatctatgtagtcttccattagttaacatgtgtatagggctttcataataagtagtcacactgttacaaggtaaattttctattacaaaatccaaatttctattgcatacacttataatcatctattcataaagctaattcattgtacttgttaatgcatgaatgttccatgcagtaggagaataaagcactacagttcggttgttcaaatcttaaatcttaggctatttagctaaaacatgttaggatattgccttcaccacttgttaggacagttatttgatagccattatgcttacctatggatagcataatggtatttaaggttcaacaaaccgcagattattatcatcagctagaactgacatatgttacaagaaaactgtaaattaacctcctgagagaaccattctgccctgcattttaagtcaggtatttaaatactgcgtgttgttaatattgcgttgtcttagtgcaacatttcttaaagtattcccgttatcttccttggctgtttttcagaggagacgtctccatgttaatgggtccttcccacatagaaatgtattctggtacagcgctgcacacatggatagcaatgtgaaaaggcatgcctaagagacagaaacggctgaccttaccccaccccagccggatcctctgcttatctcccacatgcacttggcttaactggttttcacagattctgaggttatagaacctgttgtttttcaaactcctgtacagagcctggaaataatggagcaaacgcaaatgtattgagagtcattatactttaaaatagttttaaagactattggggtaccatcaggtcaaaagccactgatttgggaagcaatttttttgcaaaacactttttttggagtactgaactttacaggggcttgccttaatctctatttagtagtttcaagatgtatgcgcaattattctacgtgttaaaaatgttaaaatattctatgtagccccaaaggtgggtaaaacagtataagtaatgcctaaattaataagctaaaaggtgtcactacagctggatttttgagagaaaatggacataaaactaggctatgtgtaataaaaataatggcaccttaagattgcactattttacgcattattttatatgccatttcatagcctgcactttaatctccaaagaaacgatgtatgatgtcccacttgttccttattcttaataaactttttcctgagacagggcacttaattctattttactgtactgaattagtttcttggaggtagattcatttcttgagttctctgtttccttagccataatattttctaggatccgggaactccctgtattgtctatttccaacattatataattttaatttaatgtaatgtaaatctcatacttggtgatcagcacattcttatatcctgctctagcaatgagtacccatttgttacacttaccaaactctctaaaaacatatactgtgagtaagatttgaagccaggaataaaaggcagtctgaaagaaaacgtcctatacgatgcagttgtttggaaatggctgatttctgatatgaaacccaacttgatacactgtttggttctttgacttgggatctatctgaattgctttcactagtacacaaaaggttaagttaaaactactttaaacttgtatagcctgccatctgaggtgaattattttcaaaaaatactaaatctatgaactgagactagcaattagttggctgctccctaccatgattttacttttaatagcaatacagttatattggtgataaatatgacaggcttaagtactgctgtccttttgcatcttcctaagcatcttggttaaatttctgaagtttaaaaattagatccagatttcttctgttgtgtctgaagagaaccatgacatttagaagtatattggtaatctattaggtccattggcaaagtatattggtccatattcaaacctattccaaaaggttagaagtgtttaagattcctttattgtggtaccatgtctgtttacctatgcttatgagcaacaataaattactagtttaccttctggaattttaattgttataaccgaatcaattattggaaagtgaaaaacacctcccggtcacacaacagggtacgtaaataaatgtgttgttaccagt

SEQ ID NO: 355025 - DNA, 1347 bp, Homo sapiens
aaggaatcaagcccccaagatggcggcagcggcggaggagcggatggcagaggaaggaggcggcggccaaggcgacggcggttcctctttggcctccggctctacccagcgacagcctccaccgcccgcgccacagcacccgcagccggggtcccaggcgctcccagcccccgcgctggctccggaccagctgcctcaaaacaacacgcttgtggcgctgcccatcgtagccatcgagaacatcctcagctttatgtcctacgacgaaattagccagctccgcctggtttgtaaaagaatggacttggtctgccagagaatgttgaatcagggatttctgaaagtggagaggtaccataatctatgtcagaaacaagttaaagcacaactcccaaggagagagtcagaaaggagaaaccattcattagctcgtcatgcagacattcttgctgctgttgaaacaaggctgtcactattaaatatgactttcatgaaatatgtggattccaatctctgttgcttcatcccaggaaaggtgattgatgagatttatcgtgtgttgagatatgtcaattctaccagagcccctcaacgagctcatgaagtacttcaagaattaagggatatatcctctatggcaatggagtactttgatgaaaagattgttccaattttaaagaggaaattaccaggatcagatgtttctggaagactcatgggctctcctccagttccaggaccgtctgcagccctaacaacaatgcagctcttctccaagcaaaatccttcaagacaagaggttaccaaactccagcagcaggttaaaacaaatggtgctggcgtgactgttctcaggcgtgaaatttctgagcttcgcaccaaagtgcaagaacagcaaaaacagcttcaagaccaggaccagaaactgctagagcagacccagatcataggtgaacaaaatgcacggttggcagagctagaacgcaaactacgagaagtaatggaaagtgctgtaggaaattcctcagggtccgggcagaatgaggagtctcctcggaaacgaaaaaaggccacggaagccatagactctcttaggaaatctaaacgtcttcggaatagaaagtaaattggaatgtggttctagttccagaggaagacacagcttagtagcttaagcagttatgcatatcaggatactgtgagcaacatggtgtcccttaagcttctaggctttcagaacacaacttaaacttgaactcttatggttgggacattcttttcctgcttctcctgattgaactgatgcacagaatctttttactttgcaatagatttgtactaaccaga

SEQ ID NO: 355026 - DNA, 1939 bp, Homo sapiens
aaggaatcaagcccccaagatggcggcagcggcggaggagcggatggcagaggaaggaggcggcggccaaggcgacggcggttcctctttggcctccggctctacccagcgacagcctccaccgcccgcgccacagcacccgcagccggggtcccaggcgctcccagcccccgcgctggctccggaccagctgcctcaaaacaacacgcttgtggcgctgcccatcgtagccatcgagaacatcctcagctttatgtcctacgacgaaattagccagctccgcctggtttgtaaaagaatggacttggtctgccagagaatgttgaatcagggatttctgaaagtggagaggtaccataatctatgtcagaaacaagttaaagcacaactcccaaggagagagtcagaaaggagaaaccattcattagctcgtcatgcagacattcttgctgctgttgaaacaaggctgtcactattaaatatgactttcatgaaatatgtggattccaatctctgttgcttcatcccaggaaaggtaaaatagaattgcttgcctagaacagctggactgccctacataaacttattatacagttatgaatttctgattttagaaatgttagaattgtttctacttctctgagtttctactaatgaatttgtttgctttctgtacagttataaatatgtatcatttgtatgatctttatatttaaaattctaattatgaaatagtcgaaaccctaatattctttagagaagttttttaagagttcatactcaagaataaaatttgaggttttactggtggttatgatgccagagatacagcaatgaacaacatacatattgtccctgccttcaagactattataattttggggaggtagaaaaggagggacaagctggtttttgttttgtttgagaaatgtttcataacgacaactttataaactttcagatttgacaagaataaacaattgctatttaccaatattcccagaactaaataacagtcctttttaacacagaaataactatattgtggcatatttaccattactaagttaataaaaactccaacattcaacatactacttataccttcagtagtaccctactccttgaattaagtgtaaattgacatatgtctgtatctttttatatggaagtggtagagatataattaaaggtcattttgctacttggttgatgctggcaaaagtttcccttaacatggttggaaataattaatatctagtaaaatttgaatgttcgctttttgttatttccaaagataatttacattggcaatatttaatacgtactttgtccatttttagttttctttgacatttatttttggggggaatcccatttcttatgattgtatttgaaatattttggtatatctcactttctttgcattatatacattttctttaaaagatcttgttgcataccaacacattacctgctaatgctttttgtagggtgctataagaggatgaccagttagaaacttcagagtgattcttatgccagatttttctgaatctgacttaaaggccttaacttttaagtgttcctgagttctttgaacttagcttgtttcatatagcatcatagtttttattgaatatctcattgttagaaacatgaatatctaagaaacatctcacagttatcataacttcaaagagattcagtcagttgttaagtaacagagttgaatagtttgtgacagagttcatgtggcctacaaagattaaaatatttatgatccaggccggctgtagtggctcgcacctctaatcccagatacttgcaaggctgaggcagaagaatcgcttgaacccgggaggcggaggttgcactgagccaagatcacaccactgcactccagcctgggcaacagagcaagactctgtctcaaaaa

SEQ ID NO: 355027 - DNA, 2938 bp, Homo sapiens
aaggaatcaagcccccaagatggcggcagcggcggaggagcggatggcagaggaaggaggcggcggccaaggcgacggcggttcctctttggcctccggctctacccagcgacagcctccaccgcccgcgccacagcacccgcagccggggtcccaggcgctcccagcccccgcgctggctccggaccagctgcctcaaaacaacacgcttgtggcgctgcccatcgtagccatcgagaacatcctcagctttatgtcctacgacgaaattagccagctccgcctggtttgtaaaagaatggacttggtctgccagagaatgttgaatcagggatttctgaaagtggagaggtaccataatctatgtcagaaacaagttaaagcacaactcccaaggagagagtcagaaaggagaaaccattcattagctcgtcatgcagacattcttgctgctgttgaaacaaggctgtcactattaaatatgactttcatgaaatatgtggattccaatctctgttgcttcatcccaggaaaggtgattgatgagatttatcgtgtgttgagatatgtcaattctaccagagcccctcaacgagctcatgaagtacttcaagaattaagggatatatcctctatggcaatggagtactttgatgaaaagattgttccaattttaaagaggaaattaccaggatcagatgtttctggaagactcatgggctctcctccagttccaggaccgtctgcagccctaacaacaatgcagctcttctccaagcaaaatccttcaagacaagaggttaccaaactccagcagcaggttaaaacaaatggtgctggcgtgactgttctcaggcgtgaaatttctgagcttcgcaccaaagtgcaagaacagcaaaaacagcttcaagaccaggaccagaaactgctagagcagacccagatcataggtgaacaaaatgcacggttggcagagctagaacgcaaactacgagaagtaatggaaagtgctgtaggaaattcctcagggtccgggcagaatgaggagtctcctcggaaacgaaaaaaggccacggaagccatagactctcttaggaaatctaaacgtcttcggaatagaaagtaaattggaatgtggttctagttccagaggaagacacagcttagtagcttaagcagttatgcatatcaggatactgtgagcaacatggtgtcccttaagcttctaggctttcagaacacaacttaaacttgaactcttatggttgggacattcttttcctgcttctcctgattgaactgatgcacagaatctttttactttgcaatagatttgtactaaccagacctgttctatcatgttttgaggagttaacttttttctgtgcagataatgttgaaagtaagttaatttgtttctgcatatatgcacatacatacgtaaggatcttaaacccagtcttgacagactagaagttaagtttaatacagaaaatgtcctgttcacttgaaagaaaagacctactttttaaatggacactatcttggttcttttttttttaagtcatctttttgttataagtgacctttgtctggaatgtctgaaaagtagttaatgctttttggtattgaagtaatgggtaactaaaatggacttccatagtattgactgtagaaggagcctctacaatattgactatatatttttataaactactggcaaggaacttacccagctgttatacatgttttcagttctctttgggggccatgtcctacatttgcatggatggatgcatgcattgcctagtcaactcacttaaaaagctcttgcactggtattgatcttgaacctctatacttctccactttttagagcggcgtcttagtttatttaaacgcttaacatcttccaccgcaacagcttgcctctagagggggaattgttcatccatttgtcctccagttttataggaacaagagactattaaagcccattgctttatctgctctctgtagggttcaggtacactggctaaggcagaaccccaaatttcaaggctctttctatcaatattggacctctgggagctaatactcctctttgctcaccaccatgtgatcattgatcagatgtggtgagtgagtaggggactcgacttgcgggatgcagttttgccattgcagcaaagttcattgaggaaaattgtaccatgaaaaagcattttgattatttcatttctggaggatgaccttgagggaagctttttaatattagtttcaagctttccttaccctacaactttaaacaaaagctttaattttgtttgcactcctattttgagcttgtaactggaaaagcatgtcttgcactgttcaacctcctgagtggtcgctttaacaacctccaaattgtgtacagtggttattttccccagttgtatagttttgagacattcaattatcactgtcttagttgtattttaatttactaaattatgtagctatttgactgttaagttcttttaaacaactgtttccttgggcttcagttatttaaagtaaatttaggtgtaatatagaaaactgtccctttccaggtgggagcttaacacctgtataaaacctaaggttttagtaagtaccttagttgaataaaagcacaaggttatcaccttttttatccgtccaccgtgacatggttatgcatcctttagattaacctcaccaaatgaagctttttctatccatttttaatattgtccttacataatattgtccttagattttgatcaattctatgtctgactttgaaattccatttacaatgtagtatgttttcaatgaaaaaccataaagtaacatccaagtgtttcatggtttgttgggaaggtaattttaaaataaaacaatttccaaaaaacatttgtcagccaag

SEQ ID NO: 355028 - DNA, 5371 bp, Homo sapiens
aaggaatcaagcccccaagatggcggcagcggcggaggagcggatggcagaggaaggaggcggcggccaaggcgacggcggttcctctttggcctccggctctacccagcgacagcctccaccgcccgcgccacagcacccgcagccggggtcccaggcgctcccagcccccgcgctggctccggaccagctgcctcaaaacaacacgcttgtggcgctgcccatcgtagccatcgagaacatcctcagctttatgtcctacgacgaaattagccagctccgcctggtttgtaaaagaatggacttggtctgccagagaatgttgaatcagggatttctgaaagtggagaggtaccataatctatgtcagaaacaagttaaagcacaactcccaaggagagagtcagaaaggagaaaccattcattagctcgtcatgcagacattcttgctgctgttgaaacaaggctgtcactattaaatatgactttcatgaaatatgtggattccaatctctgttgcttcatcccaggaaaggtgattgatgagatttatcgtgtgttgagatatgtcaattctaccagagcccctcaacgagctcatgaagtacttcaagaattaagggatatatcctctatggcaatggagtactttgatgaaaagattgttccaattttaaagaggaaattaccaggatcagatgtttctggaagactcatgggctctcctccagttccaggaccgtctgcagccctaacaacaatgcagctcttctccaagcaaaatccttcaagacaagaggttaccaaactccagcagcaggttaaaacaaatggtgctggcgtgactgttctcaggcgtgaaatttctgagcttcgcaccaaagtgcaagaacagcaaaaacagcttcaagaccaggaccagaaactgctagagcagacccagatcataggtgaacaaaatgcacggttggcagagctagaacgcaaactacgagaagtaatggaaagtgctgtaggaaattcctcagggtccgggcagaatgaggagtctcctcggaaacgaaaaaaggccacggaagccatagactctcttaggaaatctaaacgtcttcggaatagaaagtaaattggaatgtggttctagttccagaggaagacacagcttagtagcttaagcagttatgcatatcaggatactgtgagcaacatggtgtcccttaagcttctaggctttcagaacacaacttaaacttgaactcttatggttgggacattcttttcctgcttctcctgattgaactgatgcacagaatctttttactttgcaatagatttgtactaaccagacctgttctatcatgttttgaggagttaacttttttctgtgcagataatgttgaaagtaagttaatttgtttctgcatatatgcacatacatacgtaaggatcttaaacccagtcttgacagactagaagttaagtttaatacagaaaatgtcctgttcacttgaaagaaaagacctactttttaaatggacactatcttggttcttttttttttaagtcatctttttgttataagtgacctttgtctggaatgtctgaaaagtagttaatgctttttggtattgaagtaatgggtaactaaaatggacttccatagtattgactgtagaaggagcctctacaatattgactatatatttttataaactactggcaaggaacttacccagctgttatacatgttttcagttctctttgggggccatgtcctacatttgcatggatggatgcatgcattgcctagtcaactcacttaaaaagctcttgcactggtattgatcttgaacctctatacttctccactttttagagcggcgtcttagtttatttaaacgcttaacatcttccaccgcaacagcttgcctctagagggggaattgttcatccatttgtcctccagttttataggaacaagagactattaaagcccattgctttatctgctctctgtagggttcaggtacactggctaaggcagaaccccaaatttcaaggctctttctatcaatattggacctctgggagctaatactcctctttgctcaccaccatgtgatcattgatcagatgtggtgagtgagtaggggactcgacttgcgggatgcagttttgccattgcagcaaagttcattgaggaaaattgtaccatgaaaaaagtttcaagctttccttaccctacaactttaaacaaaagctttaattttgtttgcactcctattttgagcttgtaactggaaaagcatgtcttgcactgttcaacctcctgagtggtcgctttaacaacctccaaattgtgtacagtggttattttccccagttgtatagttttgagacattcaattatcactgtcttagttgtattttaatttactaaattatgtagctatttgactgttaagttcttttaaacaactgtttccttgggcttcagttatttaaagtaaatttaggtgtaatatagaaaactgtccctttccaggtgggagcttaacacctgtataaaacctaaggttttagtaagtaccttagttgaataaaagcacaaggttatcaccttttttatccgtccaccgtgacatggttatgcatcctttagattaacctcaccaaatgaagctttttctatccatttttaatattgtccttacataatattgtccttagattttgatcaattctatgtctgactttgaaattccatttacaatgtagtatgttttcaatgaaaaaccataaagtaacatccaagtgtttcatggtttgttgggaaggtaattttaaaataaaacaatttccaaaaaacatttgtcagccaaggtcatccataaaagtccccgtctggaactcattttctcagcacttctcatttttataatcatagtatttagccatattagcatatctttagaggaggcctggtggaatacccggggcctctactagtctgtttttccggtcataggaagacttttttttttacgtatcaaagtatgtgtttacagatttacagagtgtgatccgtatgcatcaaagggatacagccccagactgtttctttaatggtcattcatgaactattaaaaatttcctgaatttctttttaaactacatctagatagcctaaacatctatgtagtcttccattagttaacatgtgtatagggctttcataataagtagtcacactgttacaaggtaaattttctattacaaaatccaaatttctattgcatacacttataatcatctattcataaagctaattcattgtacttgttaatgcatgaatgttccatgcagtaggagaataaagcactacagttcggttgttcaaatcttaaatcttaggctatttagctaaaacatgttaggatattgccttcaccacttgttaggacagttatttgatagccattatgcttacctatggatagcataatggtatttaaggttcaacaaaccgcagattattatcatcagctagaactgacatatgttacaagaaaactgtaaattaacctcctgagagaaccattctgccctgcattttaagtcaggtatttaaatactgcgtgttgttaatattgcgttgtcttagtgcaacatttcttaaagtattcccgttatcttccttggctgtttttcagaggagacgtctccatgttaatgggtccttcccacatagaaatgtattctggtacagcgctgcacacatggatagcaatgtgaaaaggcatgcctaagagacagaaacggctgaccttaccccaccccagccggatcctctgcttatctcccacatgcacttggcttaactggttttcacagattctgaggttatagaacctgttgtttttcaaactcctgtacagagcctggaaataatggagcaaacgcaaatgtattgagagtcattatactttaaaatagttttaaagactattggggtaccatcaggtcaaaagccactgatttgggaagcaatttttttgcaaaacactttttttggagtactgaactttacaggggcttgccttaatctctatttagtagtttcaagatgtatgcgcaattattctacgtgttaaaaatgttaaaatattctatgtagccccaaaggtgggtaaaacagtataagtaatgcctaaattaataagctaaaaggtgtcactacagctggatttttgagagaaaatggacataaaactaggctatgtgtaataaaaataatggcaccttaagattgcactattttacgcattattttatatgccatttcatagcctgcactttaatctccaaagaaacgatgtatgatgtcccacttgttccttattcttaataaactttttcctgagacagggcacttaattctattttactgtactgaattagtttcttggaggtagattcatttcttgagttctctgtttccttagccataatattttctaggatccgggaactccctgtattgtctatttccaacattatataattttaatttaatgtaatgtaaatctcatacttggtgatcagcacattcttatatcctgctctagcaatgagtacccatttgttacacttaccaaactctctaaaaacatatactgtgagtaagatttgaagccaggaataaaaggcagtctgaaagaaaacgtcctatacgatgcagttgtttggaaatggctgatttctgatatgaaacccaacttgatacactgtttggttctttgacttgggatctatctgaattgctttcactagtacacaaaaggttaagttaaaactactttaaacttgtatagcctgccatctgaggtgaattattttcaaaaaatactaaatctatgaactgagactagcaattagttggctgctccctaccatgattttacttttaatagcaatacagttatattggtgataaatatgacaggcttaagtactgctgtccttttgcatcttcctaagcatcttggttaaatttctgaagtttaaaaattagatccagatttcttctgttgtgtctgaagagaaccatgacatttagaagtatattggtaatctattaggtccattggcaaagtatattggtccatattcaaacctattccaaaaggttagaagtgtttaagattcctttattgtggtaccatgtctgtttacctatgcttatgagcaacaataaattactagtttaccttctggaattttaattgttataaccgaatcaattattggaaagtgaaaaacacctcccggtcacacaacagggtacgtaaataaatgtgttgttaccagt

SEQ ID NO: 355029 - DNA, 721 bp, Homo sapiens
  misc_feature (343)..(343): n is a, c, g, or t
  misc_feature (346)..(346): n is a, c, g, or t
ccgatgtgggcgcgtttgctgtgtggtgtgttgtcgtgtggggtgttttgcccttcggtcctcttggtcctggtcggtcgccgtcctctcccgcctctttgtatttgttctcctctcctgttttttgttggtccccttccgttgggttctggatgtctctgtgtggtgggcgcgtggtgctcttctctcccccgctggggggtgtctagccgccgcgcccctccggctatgagttgttttttttttgttttgtttgtgtttatttgtttttgtttttggtttgttttttttttttgttgtttttttttttgtttttttttttttttttttttttttttttttnttntcacaaaaaaaagtctatatttttatattggggggagggagtagaaaagcaagcccctatactgggccctattcagtggcagcttcttgttccataggattaaggaagactctgaggaaataaaagttgtttggaaaaatccaggtgtagttgctttgtatgttgtgatgggtagaagggatgaagtgaagtgtgaaggcccctcataccctccatcttgcctcagactatgtcctggaaccctggggcggagaaagcgccactttcattcctgcttcttgggattgttgacggccacgtagtgatagagaacgacaagcaagaagagcgacacgcccagcatgttggcgaagatggcgagctgcacgtccgtga

SEQ ID NO: 355030 - DNA, 2435 bp, Homo sapiens
acggccaataggcgagagacttcttgtttcctggcagagcggggtcccggcaccgcggcgctcgggtgtttttgggggcccgggtggagggcccgggtgccggggcccaaggtgcggcctcgctagcgggagagggagcgggatcaccggcccggagagagctctcagggccagagcggggcaggaggatgctttcccagccccaccatggagctgcgctgtgggggattgctgttcagttctcgctttgattcagggaatctagcccacgtggagaaggtggaatctttgtccagtgatggggaaggggtaggaggtggggcgtcagccctgaccagtggcattgcctcttcccctgactatgaattcaacgtgtggacccgaccagactgtgctgaaacggaatttgagaatgggaacaggtcatggttctacttcagcgtccggggaggaatgccaggaaaactcatcaagatcaacattatgaacatgaacaagcagagcaagctgtattcccagggcatggccccctttgtgcgcacactgcccacccggccacgctgggaacgcattcgagaccggcccacctttgagatgacagagacgcagtttgtgttatcctttgttcatcgtttcgtggagggccgtggggccaccaccttcttcgccttctgctaccccttctcctacagtgactgccaggaactgctaaaccagctagaccagcgctttccggagaaccaccctacccatagcagccccctggataccatctattaccatcgggagctcctttgctattctctggatggacttcgtgtagatctgctgacgatcacttcctgccatgggcttcgagaagatcgagagccccgtctagagcagctatttcctgataccagcacccctcgaccattccgtttcgcaggcaagaggatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgtggtccggggacactaccgcacagactcacgtggagtgaatctgaaccgtcagtacctgaagcctgatgccgtcctgcacccggccatctatggggccaaagctgtgcttctctaccaccatgtgcactctcgtctgaactcccagagttcctctgagcaccagcccagttcctgtctccctcctgatgctcctgtttctgacctggagaaagccaacaatctccaaaatgaagctcagtgtgggcactcagctgacaggcataacgctgaagcctggaaacaaacagagccagcagaacagaagctcaacagtgtgtggattatgccacaacagtctgcggggcttgaagagtcagcccctgataccatcccccccaaagagagtggcgttgcttactatgtggacctgcatggacatgcttccaaaaggggctgcttcatgtacggaaacagctttagtgatgagagcacccaggtggaaaacatgctatatccaaagctcatctccttgaattcagcccacttcgacttccagggctgcaatttctcagagaagaatatgtatgcccgagaccgtagagatggccagtctaaagagggaagcggccgtgttgcaatctacaaagcctcagggataatccacagctacacacttgaatgcaactacaacactggacgctcagtaaacagcatccctgctgcctgccatgacaatgggcgtgccagcccccctcccccgccggctttcccctccagatacactgtggaactatttgagcaggtgggacgagctatggccattgcagccctggacatggcggaatgtaatccgtggccccgaattgtactgtcagagcacagcagccttactaatctacgggcctggatgctgaaacatgtacgcaacagccgaggcctaagcagcactctgaatgtgggtgtcaacaagaagaggggccttcgaactccacccaaaagtcacaatgggttgcctgtctcctgctccgaaaacaccttgagtcgggcacgaagttttagcaccggcacaagtgccggtggtagcagcagcagccaacaaaattctccacagatgaagaattcccccagctttccttttcatggcagtcggcctgcagggctgccaggcctgggctctagtacccaaaaggtcacccaccgggtgctgggccccgtcagaggtaagccagtctgggagcccctgcaacatgtgttcggttgtctggggcattgctgggggaagtaagagcttgaagatatactgttggcccaggaccaaggggtgaatcaataaaattagtttgtagcagaaaaaaaaac

SEQ ID NO: 355031 - DNA, 3506 bp, Homo sapiens
acggccaataggcgagagacttcttgtttcctggcagagcggggtcccggcaccgcggcgctcgggtgtttttgggggcccgggtggagggcccgggtgccggggcccaaggtgcggcctcgctagcgggagagggagcgggatcaccggcccggagagagctctcagggccagagcggggcaggaggatgctttcccagccccaccatggagctgcgctgtgggggattgctgttcagttctcgctttgattcagggaatctagcccacgtggagaaggtggaatctttgtccagtgatggggaaggggtaggaggtggggcgtcagccctgaccagtggcattgcctcttcccctgactatgaattcaacgtgtggacccgaccagactgtgctgaaacggaatttgagaatgggaacaggtcatggttctacttcagcgtccggggaggaatgccaggaaaactcatcaagatcaacattatgaacatgaacaagcagagcaagctgtattcccagggcatggccccctttgtgcgcacactgcccacccggccacgctgggaacgcattcgagaccggcccacctttgagatgacagagacgcagtttgtgttatcctttgttcatcgtttcgtggagggccgtggggccaccaccttcttcgccttctgctaccccttctcctacagtgactgccaggaactgctaaaccagctagaccagcgctttccggagaaccaccctacccatagcagccccctggataccatctattaccatcgggagctcctttgctattctctggatggacttcgtgtagatctgctgacgatcacttcctgccatgggcttcgagaagatcgagagccccgtctagagcagctatttcctgataccagcacccctcgaccattccgtttcgcaggcaagaggatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgtggtccggggacactaccgcacagactcacgtggagtgaatctgaaccgtcagtacctgaagcctgatgccgtcctgcacccggccatctatggggccaaagctgtgcttctctaccaccatgtgcactctcgtctgaactcccagagttcctctgagcaccagcccagttcctgtctccctcctgatgctcctgtttctgacctggagaaagccaacaatctccaaaatgaagctcagtgtgggcactcagctgacaggcataacgctgaagcctggaaacaaacagagccagcagaacagaagctcaacagtgtgtggattatgccacaacagtctgcggggcttgaagagtcagcccctgataccatcccccccaaagagagtggcgttgcttactatgtggacctgcatggacatgcttccaaaaggggctgcttcatgtacggaaacagctttagtgatgagagcacccaggtggaaaacatgctatatccaaagctcatctccttgaattcagcccacttcgacttccagggctgcaatttctcagagaagaatatgtatgcccgagaccgtagagatggccagtctaaagagggaagcggccgtgttgcaatctacaaagcctcagggataatccacagctacacacttgaatgcaactacaacactggacgctcagtaaacagcatccctgctgcctgccatgacaatgggcgtgccagcccccctcccccgccggctttcccctccagatacactgtggaactatttgagcaggtgggacgagctatggccattgcagccctggacatggcggaatgtaatccgtggccccgaattgtactgtcagagcacagcagccttactaatctacgggcctggatgctgaaacatgtacgcaacagccgaggcctaagcagcactctgaatgtgggtgtcaacaagaagaggggccttcgaactccacccaaaagtcacaatgggttgcctgtctcctgctccgaaaacaccttgagtcgggcacgaagttttagcaccggcacaagtgccggtggtagcagcagcagccaacaaaattctccacagatgaagaattcccccagctttccttttcatggcagtcggcctgcagggctgccaggcctgggctctagtacccaaaaggtcacccaccgggtgctgggccccgtcagagagccccgaagccaggacaggagacggcagcagcagcccctgaaccatcgtcctgcaggcagcctcgctccatccccagctcctactagttctggcccagcctcctcacacaagctgggctcctgtctactgcctgattcattcaacataccagggagcagttgctcactcttgtcctctggagacaaaccagaggctgtcatggtaatcgggaaaggtctgctagggactggagctcggatgccctgcatcaagactcgattgcagacctgtccgaggagagtttccgccaggaggggtcccggattccccaggctaggcccaggttgggccggggctcaccgccgactcgcagagggatgaaaggctcttcaggccccacatcccctaccccccggaccagggagagcagtgagctggagctgggatcctgctctgctacaccagggctgcctcaggccaggcccccacggccccgctctgcccctgccttttctcctatatcctgtagtctatctgactccccatcctggaattgttacagcaggggtcccttgggccaacctgaggtttgttttgtccctaaatctcccccactgactgtttctccccgggtctgataatgcctttatgttcaatcccaggatatagccccaagatggggtaacagtgggaaatatgctagttcccctccaggccgctgattccatgtgacagccgttaagtccttggaatgccagccacgctgtccaaggcattacagagtatcaccttgagacagaacaaaacagggacctgccaccccttccctccctccgcagcacaagattttgggaccacaaaaaaaagtctatatttttatattggggggagggagtagaaaagcaagcccctatactgggccctattcagtggcagcttcttgttccataggattaaggaagactctgaggaaataaaagttgtttggaaaaatccaggtgtagttgctttgtatgttgtgatgggtagaagggatgaagtgaagtgtgaaggcccctcataccctccatcttgcctcagactatgtcctggaaccctggggcggagaaagcgccactttcattcctgcttcttgggattgttgacggccacgtagtgatagagaacgacaagcaagaagagcgacacgcccagcatgttggcgaagatggcgagctgcacgtccgtga

SEQ ID NO: 355032 - DNA, 3281 bp, Homo sapiens
acggccaataggcgagagacttcttgtttcctggcagagcggggtcccggcaccgcggcgctcgggtgtttttgggggcccgggtggagggcccgggtgccggggcccaaggtgcggcctcgctagcgggagagggagcgggatcaccggcccggagagagctctcagggccagagcggggcaggaggatgctttcccagccccaccatggagctgcgctgtgggggattgctgttcagttctcgctttgattcagggaatctagcccacgtggagaaggtggaatctttgtccagtgatggggaaggggtaggaggtggggcgtcagccctgaccagtggcattgcctcttcccctgactatgaattcaacgtgtggacccgaccagactgtgctgaaacggaatttgagaatgggaacaggtcatggttctacttcagcgtccggggaggaatgccaggaaaactcatcaagatcaacattatgaacatgaacaagcagagcaagctgtattcccagggcatggccccctttgtgcgcacactgcccacccggccacgctgggaacgcattcgagaccggcccacctttgagatgacagagacgcagtttgtgttatcctttgttcatcgtttcgtggagggccgtggggccaccaccttcttcgccttctgctaccccttctcctacagtgactgccaggaactgctaaaccagctagaccagcgctttccggagaaccaccctacccatagcagccccctggataccatctattaccatcgggagctcctttgctattctctggatggacttcgtgtagatctgctgacgatcacttcctgccatgggcttcgagaagatcgagagccccgtctagagcagctatttcctgataccagcacccctcgaccattccgtttcgcaggcaagaggatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgtggtccggggacactaccgcacagactcacgtggagtgaatctgaaccgtcagtacctgaagcctgatgccgtcctgcacccggccatctatggggccaaagctgtgcttctctaccaccatgtgcactctcgtctgaactcccagagttcctctgagcaccagcccagttcctgtctccctcctgatgctcctgtttctgacctggagaaagccaacaatctccaaaatgaagctcagtgtgggcactcagctgacaggcataacgctgaagcctggaaacaaacagagccagcagaacagaagctcaacagtgtgtggattatgccacaacagtctgcggggcttgaagagtcagcccctgataccatcccccccaaagagagtggcgttgcttactatgtggacctgcatggacatgcttccaaaaggggctgcttcatgtacggaaacagctttagtgatgagagcacccaggtggaaaacatgctatatccaaagctcatctccttgaattcagcccacttcgacttccagggctgcaatttctcagagaagaatatgtatgcccgagaccgtagagatggccagtctaaagagggaagcggccgtgttgcaatctacaaagcctcagggataatccacagctacacacttgaatgcaactacaacactggacgctcagtaaacagcatccctgctgcctgccatgacaatgggcgtgccagcccccctcccccgccggctttcccctccagatacactgtggaactatttgagcaggtgggacgagctatggccattgcagccctggacatggcggaatgtaatccgtggccccgaattgtactgtcagagcacagcagccttactaatctacgggcctggatgctgaaacatgtacgcaacagccgaggcctaagcagcactctgaatgtgggtgtcaacaagaagaggggccttcgaactccacccaaaagtcacaatgggttgcctgtctcctgctccgaaaacaccttgagtcgggcacgaagttttagcaccggcacaagtgccggtggtagcagcagcagccaacaaaattctccacagatgaagaattcccccagctttccttttcatggcagtcggcctgcagggctgccaggcctgggctctagtacccaaaaggtcacccaccgggtgctgggccccgtcagagagccccgaagccaggacaggagacggcagcagcagcccctgaaccatcgtcctgcaggcagcctcgctccatccccagctcctactagttctggcccagcctcctcacacaagctgggctcctgtctactgcctgattcattcaacataccagggagcagttgctcactcttgtcctctggagacaaaccagaggctgtcatggtaatcgggaaaggtctgctagggactggagctcggatgccctgcatcaagactcgattgcaggctaggcccaggttgggccggggctcaccgccgactcgcagagggatgaaaggctcttcaggccccacatcccctaccccccggaccagggagagcagtgagctggagctgggatcctgctctgctacaccagggctgcctcaggccaggcccccacggccccgctctgcccctgccttttctcctatatcctgtagtctatctgactccccatcctggaattgttacagcaggggtcccttgggccaacctgaggtttgttttgtccctaaatctcccccactgactgtttctccccgggtctgataatgcctttatgttcaatcccaggatatagccccaagatggggtaacagtgggaaatatgctagttcccctccaggccgctgattccatgtgacagccgttaagtccttggaatgccagccacgctgtccaaggcattacagagtatcaccttgagacagaacaaaacagggacctgccaccccttccctccctccgcagcacaagattttgggaccacaaaaaaaagtctatatttttatattggggggagggagtagaaaagcaagcccctatactgggccctattcagtggcagcttcttgttccataggattaaggaagactctgaggaactgcaagggaaactgccagagctgcagggcgtcgagactgaactgtgctacaacgtgaactggacagctgaggccctc

SEQ ID NO: 355033 - DNA, 3393 bp, Homo sapiens
acggccaataggcgagagacttcttgtttcctggcagagcggggtcccggcaccgcggcgctcgggtgtttttgggggcccgggtggagggcccgggtgccggggcccaaggtgcggcctcgctagcgggagagggagcgggatcaccggcccggagagagctctcagggccagagcggggcaggaggatgctttcccagccccaccatggagctgcgctgtgggggattgctgttcagttctcgctttgattcagggaatctagcccacgtggagaaggtggaatctttgtccagtgatggggaaggggtaggaggtggggcgtcagccctgaccagtggcattgcctcttcccctgactatgaattcaacgtgtggacccgaccagactgtgctgaaacggaatttgagaatgggaacaggtcatggttctacttcagcgtccggggaggaatgccaggaaaactcatcaagatcaacattatgaacatgaacaagcagagcaagctgtattcccagggcatggccccctttgtgcgcacactgcccacccggccacgctgggaacgcattcgagaccggcccacctttgagatgacagagacgcagtttgtgttatcctttgttcatcgtttcgtggagggccgtggggccaccaccttcttcgccttctgctaccccttctcctacagtgactgccaggaactgctaaaccagctagaccagcgctttccggagaaccaccctacccatagcagccccctggataccatctattaccatcgggagctcctttgctattctctggatggacttcgtgtagatctgctgacgatcacttcctgccatgggcttcgagaagatcgagagccccgtctagagcagctatttcctgataccagcacccctcgaccattccgtttcgcaggcaagaggatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgtggtccggggacactaccgcacagactcacgtggagtgaatctgaaccgtcagtacctgaagcctgatgccgtcctgcacccggccatctatggggccaaagctgtgcttctctaccaccatgtgcactctcgtctgaactcccagagttcctctgagcaccagcccagttcctgtctccctcctgatgctcctgtttctgacctggagaaagccaacaatctccaaaatgaagctcagtgtgggcactcagctgacaggcataacgctgaagcctggaaacaaacagagccagcagaacagaagctcaacagtgtgtggattatgccacaacagtctgcggggcttgaagagtcagcccctgataccatcccccccaaagagagtggcgttgcttactatgtggacctgcatggacatgcttccaaaaggggctgcttcatgtacggaaacagctttagtgatgagagcacccaggtggaaaacatgctatatccaaagctcatctccttgaattcagcccacttcgacttccagggctgcaatttctcagagaagaatatgtatgcccgagaccgtagagatggccagtctaaagagggaagcggccgtgttgcaatctacaaagcctcagggataatccacagctacacacttgaatgcaactacaacactggacgctcagtaaacagcatccctgctgcctgccatgacaatgggcgtgccagcccccctcccccgccggctttcccctccagatacactgtggaactatttgagcaggtgggacgagctatggccattgcagccctggacatggcggaatgtaatccgtggccccgaattgtactgtcagagcacagcagccttactaatctacgggcctggatgctgaaacatgtacgcaacagccgaggcctaagcagcactctgaatgtgggtgtcaacaagaagaggggccttcgaactccacccaaaagtcacaatgggttgcctgtctcctgctccgaaaacaccttgagtcgggcacgaagttttagcaccggcacaagtgccggtggtagcagcagcagccaacaaaattctccacagatgaagaattcccccagctttccttttcatggcagtcggcctgcagggctgccaggcctgggctctagtacccaaaaggtcacccaccgggtgctgggccccgtcagagagccccgaagccaggacaggagacggcagcagcagcccctgaaccatcgtcctgcaggcagcctcgctccatccccagctcctactagttctggcccagcctcctcacacaagctgggctcctgtctactgcctgattcattcaacataccagggagcagttgctcactcttgtcctctggagacaaaccagaggctgtcatggtaatcgggaaaggtctgctagggactggagctcggatgccctgcatcaagactcgattgcaggctaggcccaggttgggccggggctcaccgccgactcgcagagggatgaaaggctcttcaggccccacatcccctaccccccggaccagggagagcagtgagctggagctgggatcctgctctgctacaccagggctgcctcaggccaggcccccacggccccgctctgcccctgccttttctcctatatcctgtagtctatctgactccccatcctggaattgttacagcaggggtcccttgggccaacctgaggtttgttttgtccctaaatctcccccactgactgtttctccccgggtctgataatgcctttatgttcaatcccaggatatagccccaagatggggtaacagtgggaaatatgctagttcccctccaggccgctgattccatgtgacagccgttaagtccttggaatgccagccacgctgtccaaggcattacagagtatcaccttgagacagaacaaaacagggacctgccaccccttccctccctccgcagcacaagattttgggaccacaaaaaaaagtctatatttttatattggggggagggagtagaaaagcaagcccctatactgggccctattcagtggcagcttcttgttccttaatcctatggaacaagaagctgccactgaatgaagtcgccggtcaccgttggggagaagtcagggaagaggaagaggtggcgttccccagcctcacccgtggagaccccagcgaagcgggggcaggcaggcactgctggaggagcgaaggccaggtggacacgaggacagattccagaggcttggttttatgtgcagttttctttgtcctcacc

SEQ ID NO: 355034 - DNA, 2892 bp, Homo sapiens
acggccaataggcgagagacttcttgtttcctggcagagcggggtcccggcaccgcggcgctcgggtgtttttgggggcccgggtggagggcccgggtgccggggcccaaggtgcggcctcgctagcgggagagggagcgggatcaccggcccggagagagctctcagggccagagcggggcaggaggatgctttcccagccccaccatggagctgcgctgtgggggattgctgttcagttctcgctttgattcagggaatctagcccacgtggagaaggtggaatctttgtccagtgatggggaaggggtaggaggtggggcgtcagccctgaccagtggcattgcctcttcccctgactatgaattcaacgtgtggacccgaccagactgtgctgaaacggaatttgagaatgggaacaggtcatggttctacttcagcgtccggggaggaatgccaggaaaactcatcaagatcaacattatgaacatgaacaagcagagcaagctgtattcccagggcatggccccctttgtgcgcacactgcccacccggccacgctgggaacgcattcgagaccggcccacctttgagatgacagagacgcagtttgtgttatcctttgttcatcgtttcgtggagggccgtggggccaccaccttcttcgccttctgctaccccttctcctacagtgactgccaggaactgctaaaccagctagaccagcgctttccggagaaccaccctacccatagcagccccctggataccatctattaccatcgggagctcctttgctattctctggatggacttcgtgtagatctgctgacgatcacttcctgccatgggcttcgagaagatcgagagccccgtctagagcagctatttcctgataccagcacccctcgaccattccgtttcgcaggcaagaggatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgtggtccggggacactaccgcacagactcacgtggagtgaatctgaaccgtcagtacctgaagcctgatgccgtcctgcacccggccatctatggggccaaagctgtgcttctctaccaccatgtgcactctcgtctgaactcccagagttcctctgagcaccagcccagttcctgtctccctcctgatgctcctgtttctgacctggagaaagccaacaatctccaaaatgaagctcagtgtgggcactcagctgacaggcataacgctgaagcctggaaacaaacagagccagcagaacagaagctcaacagtgtgtggattatgccacaacagtctgcggggcttgaagagtcagcccctgataccatcccccccaaagagagtggcgttgcttactatgtggacctgcatggacatgcttccaaaaggggctgcttcatgtacggaaacagctttagtgatgagagcacccaggtggaaaacatgctatatccaaagctcatctccttgaattcagcccacttcgacttccagggctgcaatttctcagagaagaatatgtatgcccgagaccgtagagatggccagtctaaagagggaagcggccgtgttgcaatctacaaagcctcagggataatccacagctacacacttgaatgcaactacaacactggacgctcagtaaacagcatccctgctgcctgccatgacaatgggcgtgccagcccccctcccccgccggctttcccctccagatacactgtggaactatttgagcaggtgggacgagctatggccattgcagccctggacatggcggaatgtaatccgtggccccgaattgtactgtcagagcacagcagccttactaatctacgggcctggatgctgaaacatgtacgcaacagccgaggcctaagcagcactctgaatgtgggtgtcaacaagaagaggggccttcgaactccacccaaaagtcacaatgggttgcctgtctcctgctccgaaaacaccttgagtcgggcacgaagttttagcaccggcacaagtgccggtggtagcagcagcagccaacaaaattctccacagatgaagaattcccccagctttccttttcatggcagtcggcctgcagggctgccaggcctgggctctagtacccaaaaggtcacccaccgggtgctgggccccgtcagagagccccgaagccaggacaggagacggcagcagcagcccctgaaccatcgtcctgcaggcagcctcgctccatccccagctcctactagttctggcccagcctcctcacacaagctgggctcctgtctactgcctgattcattcaacataccaggtctgtacccactgccactgaaatctgggtttgccagcctcctccatggccaggccaggttctttaagcctagttgggagaccaggggcatcacttatcctcttggtatcctaaacctctaacactggtgcctttgtataggaagctggaatttattaatgtgtctgtgtaataaaacaatagttaacatttactgaacatttactatgtgccaggcactgctctacacacttaatctcattttatcagttgaggaacctgaagacttttgtctacctgcaaaatgctacttatgcaaattccctgactccaggagctgggcaacactagacaaaacaggagaatgaaaaaagcatgacggtactttctcctgtcaacactgctaaatgctgtgtgtagccgtatcattcacacaaagccatctcttctcctttaaattatag

SEQ ID NO: 355035 - DNA, 2270 bp, Homo sapiens
acggccaataggcgagagacttcttgtttcctggcagagcggggtcccggcaccgcggcgctcgggtgtttttgggggcccgggtggagggcccgggtgccggggcccaaggtgcggcctcgctagcgggagagggagcgggatcaccggcccggagagagctctcagggccagagcggggcaggaggatgctttcccagccccaccatggagctgcgctgtgggggattgctgttcagttctcgctttgattcagggaatctagcccacgtggagaaggtggaatctttgtccagtgatggggaaggggtaggaggtggggcgtcagccctgaccagtggcattgcctcttcccctgactatgaattcaacgtgtggacccgaccagactgtgctgaaacggaatttgagaatgggaacaggtcatggttctacttcagcgtccggggaggaatgccaggaaaactcatcaagatcaacattatgaacatgaacaagcagagcaagctgtattcccagggcatggccccctttgtgcgcacactgcccacccggccacgctgggaacgcattcgagaccggcccacctttgagatgacagagacgcagtttgtgttatcctttgttcatcgtttcgtggagggccgtggggccaccaccttcttcgccttctgctaccccttctcctacagtgactgccaggaactgctaaaccagctagaccagcgctttccggagaaccaccctacccatagcagccccctggataccatctattaccatcgggagctcctttgctattctctggatggacttcgtgtagatctgctgacgatcacttcctgccatgggcttcgagaagatcgagagccccgtctagagcagctatttcctgataccagcacccctcgaccattccgtttcgcaggcaagaggatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgtggtccggggacactaccgcacagactcacgtggagtgaatctgaaccgtcagtacctgaagcctgatgccgtcctgcacccggccatctatggggccaaagctgtgcttctctaccaccatgtgcactctcgtctgaactcccagagttcctctgagcaccagcccagttcctgtctccctcctgatgctcctgtttctgacctggagaaagccaacaatctccaaaatgaagctcagtgtgggcactcagctgacaggcataacgctgaagcctggaaacaaacagagccagcagaacagaagctcaacagtgtgtggattatgccacaacagtctgcggggcttgaagagtcagcccctgataccatcccccccaaagagagtggcgttgcttactatgtggacctgcatggacatgcttccaaaaggggctgcttcatgtacggaaacagctttagtgatgagagcacccaggtggaaaacatgctatatccaaagctcatctccttgaattcagcccacttcgacttccagggctgcaatttctcagagaagaatatgtatgcccgagaccgtagagatggccagtctaaagagggaagcggccgtgttgcaatctacaaagcctcagggataatccacagctacacacttgaatgcaactacaacactggacgctcagtaaacagcatccctgctgcctgccatgacaatgggcgtgccagcccccctcccccgccggctttcccctccagatacactgtggaactatttgagcaggtgggacgagctatggccattgcagccctggacatggcggaatgtaatccgtggccccgaattgtactgtcagagcacagcagccttactaatctacgggcctggatgctgaaacatgtacgcaacagccgaggcctaagcagcactctgaatgtgggtgtcaacaagaagaggggccttcgaactccacccaaaagtcacaatgggttgcctgtctcctgctccgaaaacaccttgagtcgggcacgaagttttagcaccggcacaagtgccggtggtagcagcagcagccaacaaaattctccacagatgaagtaagagcttgaagatatactgttggcccaggaccaaggggtgaatcaataaaattagtttgtagcagaaaaaaaaac

SEQ ID NO: 355036 - DNA, 2436 bp, Homo sapiens
aacgctctttctgcgttcaatgtacatgtgttgagtcccagtttctgccgctttatctttcccgcctcccggcaggcaggccgttaaccgtcttccggaagacgctgctagaaccctccggccgctcctgcccgccatcgtccccgaacgacactcgctcagctctcagggccagagcggggcaggaggatgctttcccagccccaccatggagctgcgctgtgggggattgctgttcagttctcgctttgattcagggaatctagcccacgtggagaaggtggaatctttgtccagtgatggggaaggggtaggaggtggggcgtcagccctgaccagtggcattgcctcttcccctgactatgaattcaacgtgtggacccgaccagactgtgctgaaacggaatttgagaatgggaacaggtcatggttctacttcagcgtccggggaggaatgccaggaaaactcatcaagatcaacattatgaacatgaacaagcagagcaagctgtattcccagggcatggccccctttgtgcgcacactgcccacccggccacgctgggaacgcattcgagaccggcccacctttgagatgacagagacgcagtttgtgttatcctttgttcatcgtttcgtggagggccgtggggccaccaccttcttcgccttctgctaccccttctcctacagtgactgccaggaactgctaaaccagctagaccagcgctttccggagaaccaccctacccatagcagccccctggataccatctattaccatcgggagctcctttgctattctctggatggacttcgtgtagatctgctgacgatcacttcctgccatgggcttcgagaagatcgagagccccgtctagagcagctatttcctgataccagcacccctcgaccattccgtttcgcaggcaagaggatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgtggtccggggacactaccgcacagactcacgtggagtgaatctgaaccgtcagtacctgaagcctgatgccgtcctgcacccggccatctatggggccaaagctgtgcttctctaccaccatgtgcactctcgtctgaactcccagagttcctctgagcaccagcccagttcctgtctccctcctgatgctcctgtttctgacctggagaaagccaacaatctccaaaatgaagctcagtgtgggcactcagctgacaggcataacgctgaagcctggaaacaaacagagccagcagaacagaagctcaacagtgtgtggattatgccacaacagtctgcggggcttgaagagtcagcccctgataccatcccccccaaagagagtggcgttgcttactatgtggacctgcatggacatgcttccaaaaggggctgcttcatgtacggaaacagctttagtgatgagagcacccaggtggaaaacatgctatatccaaagctcatctccttgaattcagcccacttcgacttccagggctgcaatttctcagagaagaatatgtatgcccgagaccgtagagatggccagtctaaagagggaagcggccgtgttgcaatctacaaagcctcagggataatccacagctacacacttgaatgcaactacaacactggacgctcagtaaacagcatccctgctgcctgccatgacaatgggcgtgccagcccccctcccccgccggctttcccctccagatacactgtggaactatttgagcaggtgggacgagctatggccattgcagccctggacatggcggaatgtaatccgtggccccgaattgtactgtcagagcacagcagccttactaatctacgggcctggatgctgaaacatgtacgcaacagccgaggcctaagcagcactctgaatgtgggtgtcaacaagaagaggggccttcgaactccacccaaaagtcacaatgggttgcctgtctcctgctccgaaaacaccttgagtcgggcacgaagttttagcaccggcacaagtgccggtggtagcagcagcagccaacaaaattctccacagatgaagaattcccccagctttccttttcatggcagtcggcctgcagggctgccaggcctgggctctagtacccaaaaggtcacccaccgggtgctgggccccgtcagaggtaagccagtctgggagcccctgcaacatgtgttcggttgtctggggcattgctgggggaagtaagagcttgaagatatactgttggcccaggaccaaggggtgaatcaataaaattagtttgtagcagaaaaaaaaac

SEQ ID NO: 355037 - DNA, 1893 bp, Homo sapiens
cggtacccgtctgagcaagctggtacgcattcgagaccggcccacctgtgagatgacagagacgcagtttgtgttatcctttgttcatcgtttcgtggagggccgtggggccaccaccttcttcgccttctgctaccccttctcctacagtgactgccaggaactgctaaaccagctagaccagcgctttccggagaaccaccctacccatagcagccccctggataccatctattaccatcgggagctcctttgctattctctggatggacttcgtgtagatctgctgacgatcacttcctgccatgggcttcgagaagatcgagagccccgtctagagcagctatttcctgataccagcacccctcgaccattccgtttcgcaggcaagaggatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgtggtccggggacactaccgcacagactcacgtggagtgaatctgaaccgtcagtacctgaagcctgatgccgtcctgcacccggccatctatggggccaaagctgtgcttctctaccaccatgtgcactctcgtctgaactcccagagttcctctgagcaccagcccagttcctgtctccctcctgatgctcctgtttctgacctggagaaagccaacaatctccaaaatgaagctcagtgtgggcactcagctgacaggcataacgctgaagcctggaaacaaacagagccagcagaacagaagctcaacagtgtgtggattatgccacaacagtctgcggggcttgaagagtcagcccctgataccatcccccccaaagagagtggcgttgcttactatgtggacctgcatggacatgcttccaaaaggggctgcttcatgtacggaaacagctttagtgatgagagcacccaggtggaaaacatgctatatccaaagctcatctccttgaattcagcccacttcgacttccagggctgcaatttctcagagaagaatatgtatgcccgagaccgtagagatggccagtctaaagagggaagcggccgtgttgcaatctacaaagcctcagggataatccacagctacacacttgaatgcaactacaacactggacgctcagtaaacagcatccctgctgcctgccatgacaatgggcgtgccagcccccctcccccgccggctttcccctccagatacactgtggaactatttgagcaggtgggacgagctatggccattgcagccctggacatggcggaatgtaatccgtggccccgaattgtactgtcagagcacagcagccttactaatctacgggcctggatgctgaaacatgtacgcaacagccgaggcctaagcagcactctgaatgtgggtgtcaacaagaagaggggccttcgaactccacccaaaagtcacaatgggttgcctgtctcctgctccgaaaacaccttgagtcgggcacgaagttttagcaccggcacaagtgccggtggtagcagcagcagccaacaaaattctccacagatgaagaattcccccagctttccttttcatggcagtcggcctgcagggctgccaggcctgggctctagtacccaaaaggtcacccaccgggtgctgggccccgtcagaggtaagccagtctgggagcccctgcaacatgtgttcggttgtctggggcattgctgggggaagtaagagcttgaagatatactgttggcccaggaccaaggggtgaatcaataaaattagtttgtagcagaaaaaaaaac

SEQ ID NO: 355038 - DNA, 1393 bp, Homo sapiens
tgagacagtctcactctgtcgcccaggctggtggagaatggataactgtaataaatagtaggtctttctacccatcttatattaatagttacttcaggagagggatgtgggtctgatgacaagcttgaaaactggcatcttttgaccacggaagccagcaggtcagtgaaggctgcctcatagtgccccacttatttgcccttttatctgcttgtatctcttccactcagagccccgaagccaggacaggagacggcagcagcagcccctgaaccatcgtcctgcaggcagcctcgctccatccccagctcctactagttctggcccagcctcctcacacaagctgggctcctgtctactgcctgattcattcaacataccagggagcagttgctcactcttgtcctctggagacaaaccagaggctgtcatggtaatcgggaaaggtctgctagggactggagctcggatgccctgcatcaagactcgattgcaggctaggcccaggttgggccggggctcaccgccgactcgcagagggatgaaaggctcttcaggccccacatcccctaccccccggaccagggagagcagtgagctggagctgggatcctgctctgctacaccagggctgcctcaggccaggcccccacggccccgctctgcccctgccttttctcctatatcctgtagtctatctgactccccatcctggaattgttacagcaggggtcccttgggccaacctgaggtttgttttgtccctaaatctcccccactgactgtttctccccgggtctgataatgcctttatgttcaatcccaggatatagccccaagatggggtaacagtgggaaatatgctagttcccctccaggccgctgattccatgtgacagccgttaagtccttggaatgccagccacgctgtccaaggcattacagagtatcaccttgagacagaacaaaacagggacctgccaccccttccctccctccgcagcacaagattttgggaccacaaaaaaaagtctatatttttatattggggggagggagtagaaaagcaagcccctatactgggccctattcagtggcagcttcttgttccataggattaaggaagactctgaggaaataaaagttgtttggaaaaatccaggtgtagttgctttgtatgttgtgatgggtagaagggatgaagtgaagtgtgaaggcccctcataccctccatcttgcctcagactatgtcctggaaccctggggcggagaaagcgccactttcattcctgcttcttgggattgttgacggccacgtagtgatagagaacgacaagcaagaagagcgacacgcccagcatgttggcgaagatggcgagctgcacgtccgtga

SEQ ID NO: 355039 - DNA, 1142 bp, Homo sapiens
aagtgtacactgctctggcaggggctaaagcatagagggctctgagagaggtctaccaaccctccactatctttctacacagtgtttctctactcacccagaccttagtcatggtgtagccatggcggttaaatgctggatccgtttgccacccctagttatagacttggaaactctagaagcaaactaaaagcaaaaaactcatggaagaatccagcctcttagcgcaaaccctgtccacacaggctaggcccaggttgggccggggctcaccgccgactcgcagagggatgaaaggctcttcaggccccacatcccctaccccccggaccagggagagcagtgagctggagctgggatcctgctctgctacaccagggctgcctcaggccaggcccccacggccccgctctgcccctgccttttctcctatatcctgtagtctatctgactccccatcctggaattgttacagcaggggtcccttgggccaacctgaggtttgttttgtccctaaatctcccccactgactgtttctccccgggtctgataatgcctttatgttcaatcccaggatatagccccaagatggggtaacagtgggaaatatgctagttcccctccaggccgctgattccatgtgacagccgttaagtccttggaatgccagccacgctgtccaaggcattacagagtatcaccttgagacagaacaaaacagggacctgccaccccttccctccctccgcagcacaagattttgggaccacaaaaaaaagtctatatttttatattggggggagggagtagaaaagcaagcccctatactgggccctattcagtggcagcttcttgttccataggattaaggaagactctgaggaaataaaagttgtttggaaaaatccaggtgtagttgctttgtatgttgtgatgggtagaagggatgaagtgaagtgtgaaggcccctcataccctccatcttgcctcagactatgtcctggaaccctggggcggagaaagcgccactttcattcctgcttcttgggattgttgacggccacgtagtgatagagaacgacaagcaagaagagcgacacgcccagcatgttggcgaagatggcgagctgcacgtccgtga

SEQ ID NO: 355040 - DNA, 471 bp, Homo sapiens
cttctctctctctctcccccccccccccccccctaaaaaaaaaaaaaaaaaaaaaaaaaaaaaaaaaaaaaaaaaaaaaaaaaaaaaaaaaaaaaaacacaaaaaaaagtctatatttttatattggggggagggagtagaaaagcaagcccctatactgggccctattcagtggcagcttcttgttccataggattaaggaagactctgaggaaataaaagttgtttggaaaaatccaggtgtagttgctttgtatgttgtgatgggtagaagggatgaagtgaagtgtgaaggcccctcataccctccatcttgcctcagactatgtcctggaaccctggggcggagaaagcgccactttcattcctgcttcttgggattgttgacggccacgtagtgatagagaacgacaagcaagaagagcgacacgcccagcatgttggcgaagatggcgagctgcacgtccgtga

SEQ ID NO: 355041 - DNA, 459 bp, Homo sapiens
tttttctccccccacaaatataaaaaaaaaataaaaaaaaaaaaaaaaaaaacaaaaaaaaaaaaaaaaaaaaaaaaaaaaaaaacacaaaaaaaagtctatatttttatattggggggagggagtagaaaagcaagcccctatactgggccctattcagtggcagcttcttgttccataggattaaggaagactctgaggaaataaaagttgtttggaaaaatccaggtgtagttgctttgtatgttgtgatgggtagaagggatgaagtgaagtgtgaaggcccctcataccctccatcttgcctcagactatgtcctggaaccctggggcggagaaagcgccactttcattcctgcttcttgggattgttgacggccacgtagtgatagagaacgacaagcaagaagagcgacacgcccagcatgttggcgaagatggcgagctgcacgtccgtga

SEQ ID NO: 355042 - DNA, 439 bp, Homo sapiens
cttctctctctctctcccccccccccccccccctaaaaaaaaaaaaaaaaaaaaaaaaaaaaaaacacaaaaaaaagtctatatttttatattggggggagggagtagaaaagcaagcccctatactgggccctattcagtggcagcttcttgttccataggattaaggaagactctgaggaaataaaagttgtttggaaaaatccaggtgtagttgctttgtatgttgtgatgggtagaagggatgaagtgaagtgtgaaggcccctcataccctccatcttgcctcagactatgtcctggaaccctggggcggagaaagcgccactttcattcctgcttcttgggattgttgacggccacgtagtgatagagaacgacaagcaagaagagcgacacgcccagcatgttggcgaagatggcgagctgcacgtccgtga

SEQ ID NO: 355043 - DNA, 826 bp, Homo sapiens
tgagacagtctcactctgtcgcccaggctggtggagaatggataactgtaataaatagtaggtctttctacccatcttatattaatagttacttcaggagagggatgtgggtctgatgacaagcttgaaaactggcatcttttgaccacggaagccagcaggtcagtgaaggctgcctcatagtgccccacttatttgcccttttatctgcttgtatctcttccactcagagccccgaagccaggacaggagacggcagcagcagcccctgaaccatcgtcctgcaggcagcctcgctccatccccagctcctactagttctggcccagcctcctcacacaagctgggctcctgtctactgcctgattcattcaacataccaggtctgtacccactgccactgaaatctgggtttgccagcctcctccatggccaggccaggttctttaagcctagttgggagaccaggggcatcacttatcctcttggtatcctaaacctctaacactggtgcctttgtataggaagctggaatttattaatgtgtctgtgtaataaaacaatagttaacatttactgaacatttactatgtgccaggcactgctctacacacttaatctcattttatcagttgaggaacctgaagacttttgtctacctgcaaaatgctacttatgcaaattccctgactccaggagctgggcaacactagacaaaacaggagaatgaaaaaagcatgacggtactttctcctgtcaacactgctaaatgctgtgtgtagccgtatcattcacacaaagccatctcttctcctttaaattatag

SEQ ID NO: 355044 - DNA, 702 bp, Homo sapiens
cctctctcttttctgttgcaggctgcctcaggccaggcccccacggccccgctctgcccctgccttttctcctatatcctgtagtctatctgactccccatcctggaattgttacagcaggggtcccttgggccaacctgaggtttgttttgtccctaaatctcccccactgactgtttctccccgggtctgataatgcctttatgttcaatcccaggatatagccccaagatggggtaacagtgggaaatatgctagttcccctccaggccgctgattccatgtgacagccgttaagtccttggaatgccagccacgctgtccaaggcattacagagtatcaccttgagacagaacaaaacagggactagaaaagcaagcccctatactgggccctattcagtggcagcttcttgttccataggattaaggaagactctgaggaaataaaagttgtttggaaaaatccaggtgtagttgctttgtatgttgtgatgggtagaagggatgaagtgaagtgtgaaggcccctcataccctccatcttgcctcagactatgtcctggaaccctggggcggagaaagcgccactttcattcctgcttcttgggattgttgacggccacgtagtgatagagaacgacaagcaagaagagcgacacgcccagcatgttggcgaagatggcgagctgcacgtccgtga

SEQ ID NO: 355045 - DNA, 124 bp, Homo sapiens
gtgtttttgggggcccgggtggagggcccgggtgccggggcccaaggtgcggcctcgctagcgggagagggagcgggatcaccggcccggagagaggtgaggggctctgcgcggactacgggcc

SEQ ID NO: 355046 - DNA, 453 bp, Homo sapiens
aaaagtctatatttttatattggggggagggagtagaaaagcaagcccctatactgggccctattcagtggcagcttcttgttccataggattaaggaagactctgaggaaataaaagttgtttggaaaaatccaggtgtagttgctttgtatgttgtgatgggtagaagggatgaagtgaagtgtgaaggcccctcataccctccatcttgcctcagactatgtcctggaaccctagaaaagagggggaaagacctgaggtaaggaaaatgctgcagctttcctctggggaatccttcaggaagtaacgcccatccatgttccctttatacttgtgacccacacttaaggctggctccaaagcccccccttccttctctatagtttgggtcagcagccaacccctggcctcagaacatggaaacagaattctacatctgtcacccccctcac

SEQ ID NO: 355047 - DNA, 626 bp, Homo sapiens
  misc_feature (7)..(7): n is a, c, g, or t
  misc_feature (93)..(94): n is a, c, g, or t
cacaccntgggtgacaggccctgggaggccctcaaagggacaccccctttctactactatgcattctatgagcttgtagccaaaggcagtgcnntgtgccttgggcacacctaataagtgcagttctgcacctggaaccccaagccaatgtggtgaggacaatgggaggggcattctgttgctggtgggtggggcaagctgggactccagagcaggcctgccttgccctcctccctatcaggtacatgggctttgcatctgtccccaccagtcggtgcacactgtgagtgctgccaagacctgcaccaggatcatccatgacatgcagcagagcctgggcacccccatgcctgctgggatgaatgccatgctctactctgcctggccatacctgccacaggtccgcccaccccatatctacctttctggttctgcctcagaatgtgagtgccatgggcatgtctacagttgtcactttgacacagctgtaagccagtctgggagcccctgcaacatgtgttcggttgtctggggcattgctgggggaagtaagagcttgaagatatactgttggcccaggaccaaggggtgaatcaataaaattagtttgtagcagaaaaaaaaac

SEQ ID NO: 355048 - DNA, 3459 bp, Homo sapiens
acggccaataggcgagagacttcttgtttcctggcagagcggggtcccggcaccgcggcgctcgggtgtttttgggggcccgggtggagggcccgggtgccggggcccaaggtgcggcctcgctagcgggagagggagcgggatcaccggcccggagagagctctcagggccagagcggggcaggaggatgctttcccagccccaccatggagctgcgctgtgggggattgctgttcagttctcgctttgattcagggaatctagcccacgtggagaaggtggaatctttgtccagtgatggggaaggggtaggaggtggggcgtcagccctgaccagtggcattgcctcttcccctgactatgaattcaacgtgtggacccgaccagactgtgctgaaacggaatttgagaatgggaacaggtcatggttctacttcagcgtccggggaggaatgccaggaaaactcatcaagatcaacattatgaacatgaacaagcagagcaagctgtattcccagggcatggccccctttgtgcgcacactgcccacccggccacgctgggaacgcattcgagaccggcccacctttgagatgacagagacgcagtttgtgttatcctttgttcatcgtttcgtggagggccgtggggccaccaccttcttcgccttctgctaccccttctcctacagtgactgccaggaactgctaaaccagctagaccagcgctttccggagaaccaccctacccatagcagccccctggataccatctattaccatcgggagctcctttgctattctctggatggacttcgtgtagatctgctgacgatcacttcctgccatgggcttcgagaagatcgagagccccgtctagagcagctatttcctgataccagcacccctcgaccattccgtttcgcaggcaagaggatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgtggtccggggacactaccgcacagactcacgtggagtgaatctgaaccgtcagtacctgaagcctgatgccgtcctgcacccggccatctatggggccaaagctgtgcttctctaccaccatgtgcactctcgtctgaactcccagagttcctctgagcaccagcccagttcctgtctccctcctgatgctcctgtttctgacctggagaaagccaacaatctccaaaatgaagctcagtgtgggcactcagctgacaggcataacgctgaagcctggaaacaaacagagccagcagaacagaagctcaacagtgtgtggattatgccacaacagtctgcggggcttgaagagtcagcccctgataccatcccccccaaagagagtggcgttgcttactatgtggacctgcatggacatgcttccaaaaggggctgcttcatgtacggaaacagctttagtgatgagagcacccaggtggaaaacatgctatatccaaagctcatctccttgaattcagcccacttcgacttccagggctgcaatttctcagagaagaatatgtatgcccgagaccgtagagatggccagtctaaagagggaagcggccgtgttgcaatctacaaagcctcagggataatccacagctacacacttgaatgcaactacaacactggacgctcagtaaacagcatccctgctgcctgccatgacaatgggcgtgccagcccccctcccccgccggctttcccctccagatacactgtggaactatttgagcaggtgggacgagctatggccattgcagccctggacatggcggaatgtaatccgtggccccgaattgtactgtcagagcacagcagccttactaatctacgggcctggatgctgaaacatgtacgcaacagccgaggcctaagcagcactctgaatgtgggtgtcaacaagaagaggggccttcgaactccacccaaaagtcacaatgggttgcctgtctcctgctccgaaaacaccttgagtcgggcacgaagttttagcaccggcacaagtgccggtggtagcagcagcagccaacaaaattctccacagatgaagaattcccccagctttccttttcatggcagtcggcctgcagggctgccaggcctgggctctagtacccaaaaggtcacccaccgggtgctgggccccgtcagagagccccgaagccaggacaggagacggcagcagcagcccctgaaccatcgtcctgcaggcagcctcgctccatccccagctcctactagttctggcccagcctcctcacacaagctgggctcctgtctactgcctgattcattcaacataccagggagcagttgctcactcttgtcctctggagacaaaccagaggctgtcatggtaatcgggaaaggtctgctagggactggagctcggatgccctgcatcaagactcgattgcaggctaggcccaggttgggccggggctcaccgccgactcgcagagggatgaaaggctcttcaggccccacatcccctaccccccggaccagggagagcagtgagctggagctgggatcctgctctgctacaccagggctgcctcaggccaggcccccacggccccgctctgcccctgccttttctcctatatcctgtagtctatctgactccccatcctggaattgttacagcaggggtcccttgggccaacctgaggtttgttttgtccctaaatctcccccactgactgtttctccccgggtctgataatgcctttatgttcaatcccaggatatagccccaagatggggtaacagtgggaaatatgctagttcccctccaggccgctgattccatgtgacagccgttaagtccttggaatgccagccacgctgtccaaggcattacagagtatcaccttgagacagaacaaaacagggacctgccaccccttccctccctccgcagcacaagattttgggaccacaaaaaaaagtctatatttttatattggggggagggagtagaaaagcaagcccctatactgggccctattcagtggcagcttcttgttccataggattaaggaagactctgaggaaataaaagttgtttggaaaaatccaggtgtagttgctttgtatgttgtgatgggtagaagggatgaagtgaagtgtgaaggcccctcataccctccatcttgcctcagactatgtcctggaaccctggggcggagaaagcgccactttcattcctgcttcttgggattgttgacggccacgtagtgatagagaacgacaagcaagaagagcgacacgcccagcatgttggcgaagatggcgagctgcacgtccgtga

SEQ ID NO: 355049 - DNA, 2919 bp, Homo sapiens
acggccaataggcgagagacttcttgtttcctggcagagcggggtcccggcaccgcggcgctcgggtgtttttgggggcccgggtggagggcccgggtgccggggcccaaggtgcggcctcgctagcgggagagggagcgggatcaccggcccggagagagctctcagggccagagcggggcaggaggatgctttcccagccccaccatggagctgcgctgtgggggattgctgttcagttctcgctttgattcagggaatctagcccacgtggagaaggtggaatctttgtccagtgatggggaaggggtaggaggtggggcgtcagccctgaccagtggcattgcctcttcccctgactatgaattcaacgtgtggacccgaccagactgtgctgaaacggaatttgagaatgggaacaggtcatggttctacttcagcgtccggggaggaatgccaggaaaactcatcaagatcaacattatgaacatgaacaagcagagcaagctgtattcccagggcatggccccctttgtgcgcacactgcccacccggccacgctgggaacgcattcgagaccggcccacctttgagatgacagagacgcagtttgtgttatcctttgttcatcgtttcgtggagggccgtggggccaccaccttcttcgccttctgctaccccttctcctacagtgactgccaggaactgctaaaccagctagaccagcgctttccggagaaccaccctacccatagcagccccctggataccatctattaccatcgggagctcctttgctattctctggatggacttcgtgtagatctgctgacgatcacttcctgccatgggcttcgagaagatcgagagccccgtctagagcagctatttcctgataccagcacccctcgaccattccgtttcgcaggcaagaggatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgtggtccggggacactaccgcacagactcacgtggagtgaatctgaaccgtcagtacctgaagcctgatgccgtcctgcacccggccatctatggggccaaagctgtgcttctctaccaccatgtgcactctcgtctgaactcccagagttcctctgagcaccagcccagttcctgtctccctcctgatgctcctgtttctgacctggagaaagccaacaatctccaaaatgaagctcagtgtgggcactcagctgacaggcataacgctgaagcctggaaacaaacagagccagcagaacagaagctcaacagtgtgtggattatgccacaacagtctgcggggcttgaagagtcagcccctgataccatcccccccaaagagagtggcgttgcttactatgtggacctgcatggacatgcttccaaaaggggctgcttcatgtacggaaacagctttagtgatgagagcacccaggtgggaatcctaagaatgtcatgtgagtgtgagaagtgttacaggttaggagatggggttaggccatgaacagaaggaagatagccttaggtagctttctggaaggaaggcctgtgtagactacctctgaaaaagctttgaagggccaagaagagatggcacagggggataatgtctcaattgttacatcatgaccttttattaaggaaagctaactgcattatagtctgctagagtctgggaatccagagaaggaaaattttgcattgttggagggaggaagctaaaagcttaaaaaaaaaagaattgcttcccaacacctagaagtaatgtcaaactgagaattcaggcagcactgattactgttaatggttgtgatggtatctgctgtgtattaagtcacatggtcgcatacttgctatctcttccttgcaccttgtcccttctgtctctccttctgagttgacttttcttccccaaacaggtggaaaacatgctatatccaaagctcatctccttgaattcagcccacttcgacttccagggctgcaatttctcagagaagaatatgtatgcccgagaccgtagagatggccagtctaaagagggaagcggccgtgttgcaatctacaaagcctcagggataatccacagctacacacttgaatgcaactacaacactggacgctcagtaaacagcatccctgctgcctgccatgacaatgggcgtgccagcccccctcccccgccggctttcccctccagatacactgtggaactatttgagcaggtgggacgagctatggccattgcagccctggacatggcggaatgtaatccgtggccccgaattgtactgtcagagcacagcagccttactaatctacgggcctggatgctgaaacatgtacgcaacagccgaggcctaagcagcactctgaatgtgggtgtcaacaagaagaggggccttcgaactccacccaaaagtcacaatgggttgcctgtctcctgctccgaaaacaccttgagtcgggcacgaagttttagcaccggcacaagtgccggtggtagcagcagcagccaacaaaattctccacagatgaagaattcccccagctttccttttcatggcagtcggcctgcagggctgccaggcctgggctctagtacccaaaaggtcacccaccgggtgctgggccccgtcagaggtaagccagtctgggagcccctgcaacatgtgttcggttgtctggggcattgctgggggaagtaagagcttgaagatatactgttggcccaggaccaaggggtgaatcaataaaattagtttgtagcagaaaaaaaaac

SEQ ID NO: 355050 - DNA, 2945 bp, Homo sapiens
acggccaataggcgagagacttcttgtttcctggcagagcggggtcccggcaccgcggcgctcgggtgtttttgggggcccgggtggagggcccgggtgccggggcccaaggtgcggcctcgctagcgggagagggagcgggatcaccggcccggagagagctctcagggccagagcggggcaggaggatgctttcccagccccaccatggagctgcgctgtgggggattgctgttcagttctcgctttgattcagggaatctagcccacgtggagaaggtggaatctttgtccagtgatggggaaggggtaggaggtggggcgtcagccctgaccagtggcattgcctcttcccctgactatgaattcaacgtgtggacccgaccagactgtgctgaaacggaatttgagaatgggaacaggtcatggttctacttcagcgtccggggaggaatgccaggaaaactcatcaagatcaacattatgaacatgaacaagcagagcaagctgtattcccagggcatggccccctttgtgcgcacactgcccacccggccacgctgggaacgcattcgagaccggcccacctttgagatgacagagacgcagtttgtgttatcctttgttcatcgtttcgtggagggccgtggggccaccaccttcttcgccttctgctaccccttctcctacagtgactgccaggaactgctaaaccagctagaccagcgctttccggagaaccaccctacccatagcagccccctggataccatctattaccatcgggagctcctttgctattctctggatggacttcgtgtagatctgctgacgatcacttcctgccatgggcttcgagaagatcgagagccccgtctagagcagctatttcctgataccagcacccctcgaccattccgtttcgcaggcaagaggatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgtggtccggggacactaccgcacagactcacgtggagtgaatctgaaccgtcagtacctgaagcctgatgccgtcctgcacccggccatctatggggccaaagctgtgcttctctaccaccatgtgcactctcgtctgaactcccagagttcctctgagcaccagcccagttcctgtctccctcctgatgctcctgtttctgacctggagaaagccaacaatctccaaaatgaagctcagtgtgggcactcagctgacaggcataacgctgaagcctggaaacaaacagagccagcagaacagaagctcaacagtgtgtggattatgccacaacagtctgcggggcttgaagagtcagcccctgataccatcccccccaaagagagtggcgttgcttactatgtggacctgcatggacatgcttccaaaaggggctgcttcatgtacggaaacagctttagtgatgagagcacccaggtggaaaacatgctatatccaaagctcatctccttgaattcagcccacttcgacttccagggctgcaatttctcagagaagaatatgtatgcccgagaccgtagagatggccagtctaaagagggaagcggccgtgttgcaatctacaaagcctcagggataatccacaggttgggtggaagctgagatatagttgatgaaatagcttccctaaagaaaacaccgtagctgggtgtggtggtgcatgcttgtaatcccagctactgaggaggctgaggcaggagaatcgcttgaacctgggaggcagaggttgtggcgagccgagatcgcgccattgcactccagcctgggcaacaagagcgaaactccgtctcaaaaaaaaaacaaaaaacaacacccagttcagggtgtttgagagggagggaaccaccttagtcttcttaaaagagaacctcacaattagcattattgtctttagtctaggactctaccttggggggactctctgggtatatggtacagtaccaaggtcagctgctagttgctatggattattagcactttcatttgtgttcacttttttccaagtgattgcctcctttgaccacctaagttgtcctctatggttctgtcctggtatctgttcaggcgggacactgataaaggtctttatgtcttagctacacacttgaatgcaactacaacactggacgctcagtaaacagcatccctgctgcctgccatgacaatgggcgtgccagcccccctcccccgccggctttcccctccagatacactgtggaactatttgagcaggtgggacgagctatggccattgcagccctggacatggcggaatgtaatccgtggccccgaattgtactgtcagagcacagcagccttactaatctacgggcctggatgctgaaacatgtacgcaacagccgaggcctaagcagcactctgaatgtgggtgtcaacaagaagaggggccttcgaactccacccaaaagtcacaatgggttgcctgtctcctgctccgaaaacaccttgagtcgggcacgaagttttagcaccggcacaagtgccggtggtagcagcagcagccaacaaaattctccacagatgaagaattcccccagctttccttttcatggcagtcggcctgcagggctgccaggcctgggctctagtacccaaaaggtcacccaccgggtgctgggccccgtcagaggtaagccagtctgggagcccctgcaacatgtgttcggttgtctggggcattgctgggggaagtaagagcttgaagatatactgttggcccaggaccaaggggtgaatcaataaaattagtttgtagcagaaaaaaaaac

SEQ ID NO: 355051 - DNA, 3199 bp, Homo sapiens
acggccaataggcgagagacttcttgtttcctggcagagcggggtcccggcaccgcggcgctcgggtgtttttgggggcccgggtggagggcccgggtgccggggcccaaggtgcggcctcgctagcgggagagggagcgggatcaccggcccggagagagctctcagggccagagcggggcaggaggatgctttcccagccccaccatggagctgcgctgtgggggattgctgttcagttctcgctttgattcagggaatctagcccacgtggagaaggtggaatctttgtccagtgatggggaaggggtaggaggtggggcgtcagccctgaccagtggcattgcctcttcccctgactatgaattcaacgtgtggacccgaccagactgtgctgaaacggaatttgagaatgggaacaggtcatggttctacttcagcgtccggggaggaatgccaggaaaactcatcaagatcaacattatgaacatgaacaagcagagcaagctgtattcccagggcatggccccctttgtgcgcacactgcccacccggccacgctgggaacgcattcgagaccggcccacctttgagatgacagagacgcagtttgtgttatcctttgttcatcgtttcgtggagggccgtggggccaccaccttcttcgccttctgctaccccttctcctacagtgactgccaggaactgctaaaccagctagaccagcgctttccggagaaccaccctacccatagcagccccctggataccatctattaccatcgggagctcctttgctattctctggatggacttcgtgtagatctgctgacgatcacttcctgccatgggcttcgagaagatcgagagccccgtctagagcagctatttcctgataccagcacccctcgaccattccgtttcgcaggcaagaggatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgtggtccggggacactaccggtaagtggcttccccagcctgtctggactgttcccatttcccctcatgccctgcatctcagtgaaattctgtcagccttctggcttctgtgttcccagtcctcttgcaccctaataaaggcaagcccatctcatcttcctgagaaagcatgagatcatatctagtggcactcccagaaaggaaccaaactaggatgactgcaggcccatctgggtggaggcagctaccctgaggaagctccttagggttctatgcacagactcacgtggagtgaatctgaaccgtcagtacctgaagcctgatgccgtcctgcacccggccatctatggggccaaagctgtgcttctctaccaccatgtgcactctcgtctgaactcccagagttcctctgagcaccagcccagttcctgtctccctcctgatgctcctgtttctgacctggagaaagccaacaatctccaaaatgaagctcagtgtgggcactcagctgacaggcataacgctgaagcctggaaacaaacagagccagcagaacagaagctcaacagtgtgtggattatgccacaacagtctgcggggcttgaagagtcagcccctgataccatcccccccaaagagagtggcgttgcttactatgtggacctgcatggacatgcttccaaaaggggctgcttcatgtacggaaacagctttagtgatgagagcacccaggtggaaaacatgctatatccaaagctcatctccttgaattcagcccacttcgacttccagggctgcaatttctcagagaagaatatgtatgcccgagaccgtagagatggccagtctaaagagggaagcggccgtgttgcaatctacaaagcctcagggataatccacaggttgggtggaagctgagatatagttgatgaaatagcttccctaaagaaaacaccgtagctgggtgtggtggtgcatgcttgtaatcccagctactgaggaggctgaggcaggagaatcgcttgaacctgggaggcagaggttgtggcgagccgagatcgcgccattgcactccagcctgggcaacaagagcgaaactccgtctcaaaaaaaaaacaaaaaacaacacccagttcagggtgtttgagagggagggaaccaccttagtcttcttaaaagagaacctcacaattagcattattgtctttagtctaggactctaccttggggggactctctgggtatatggtacagtaccaaggtcagctgctagttgctatggattattagcactttcatttgtgttcacttttttccaagtgattgcctcctttgaccacctaagttgtcctctatggttctgtcctggtatctgttcaggcgggacactgataaaggtctttatgtcttagctacacacttgaatgcaactacaacactggacgctcagtaaacagcatccctgctgcctgccatgacaatgggcgtgccagcccccctcccccgccggctttcccctccagatacactgtggaactatttgagcaggtgggacgagctatggccattgcagccctggacatggcggaatgtaatccgtggccccgaattgtactgtcagagcacagcagccttactaatctacgggcctggatgctgaaacatgtacgcaacagccgaggcctaagcagcactctgaatgtgggtgtcaacaagaagaggggccttcgaactccacccaaaagtcacaatgggttgcctgtctcctgctccgaaaacaccttgagtcgggcacgaagttttagcaccggcacaagtgccggtggtagcagcagcagccaacaaaattctccacagatgaagaattcccccagctttccttttcatggcagtcggcctgcagggctgccaggcctgggctctagtacccaaaaggtcacccaccgggtgctgggccccgtcagaggtaagccagtctgggagcccctgcaacatgtgttcggttgtctggggcattgctgggggaagtaagagcttgaagatatactgttggcccaggaccaaggggtgaatcaataaaattagtttgtagcagaaaaaaaaac

SEQ ID NO: 355052 - DNA, 1602 bp, Homo sapiens
acggccaataggcgagagacttcttgtttcctggcagagcggggtcccggcaccgcggcgctcgggtgtttttgggggcccgggtggagggcccgggtgccggggcccaaggtgcggcctcgctagcgggagagggagcgggatcaccggcccggagagagctctcagggccagagcggggcaggaggatgctttcccagccccaccatggagctgcgctgtgggggattgctgttcagttctcgctttgattcagggaatctagcccacgtggagaaggtggaatctttgtccagtgatggggaaggggtaggaggtggggcgtcagccctgaccagtggcattgcctcttcccctgactatgaattcaacgtgtggacccgaccagactgtgctgaaacggaatttgagaatgggaacaggtcatggttctacttcagcgtccggggaggaatgccaggaaaactcatcaagatcaacattatgaacatgaacaagcagagcaagctgtattcccagggcatggccccctttgtgcgcacactgcccacccggccacgctgggaacgcattcgagaccggcccacctttgagatgacagagacgcagtttgtgttatcctttgttcatcgtttcgtggagggccgtggggccaccaccttcttcgccttctgctaccccttctcctacagtgactgccaggaactgctaaaccagctagaccagcgctttccggagaaccaccctacccatagcagccccctggataccatctattaccatcgggagctcctttgctattctctggatggacttcgtgtagatctgctgacgatcacttcctgccatgggcttcgagaagatcgagagccccgtctagagcagctatttcctgataccagcacccctcgaccattccgtttcgcaggcaagaggatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgtggtccggggacactaccgcacagactcacgtggagtgaatctgaaccgtcagtacctgaagcctgatgccgtcctgcacccggccatctatggggccaaagctgtgcttctctaccaccatgtgcactctcgtctgaactcccagagttcctctgagcaccagcccagttcctgtctccctcctgatgctcctgtttctgacctggagaaagccaacaatctccaaaatgaagctcagtgtgggcactcagctgacaggcataacgctgaagcctggaaacaaacagagccagcagaacagaagctcaacagtgtgtggattatgccacaacagtctgcggggcttgaagagtcagcccctgataccatcccccccaaagagagtggcgttgcttactatgtggacctgcatggacatgcttccaaaaggggctgcttcatgtacggaacatatgggggaaaagaatcacacagggggaaaacatacgatataccataactgaat

SEQ ID NO: 355053 - DNA, 1888 bp, Homo sapiens
acatatgtactaggtctgtgcccgggtgttacgtcagtcgcggggggctagagccaggtttatagtatcctcgtccgtcgtctgtcacttgcaacggccgtggggccaccaccttcttcgccttctgctaccccttctcctacagtgactgccaggaactgctaaaccagctagaccagcgctttccggagaaccaccctacccatagcagccccctggataccatctattaccatcgggagctcctttgctattctctggatggacttcgtgtagatctgctgacgatcacttcctgccatgggcttcgagaagatcgagagccccgtctagagcagctatttcctgataccagcacccctcgaccattccgtttcgcaggcaagaggatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgtggtccggggacactaccgcacagactcacgtggagtgaatctgaaccgtcagtacctgaagcctgatgccgtcctgcacccggccatctatggggccaaagctgtgcttctctaccaccatgtgcactctcgtctgaactcccagagttcctctgagcaccagcccagttcctgtctccctcctgatgctcctgtttctgacctggagaaagccaacaatctccaaaatgaagctcagtgtgggcactcagctgacaggcataacgctgaagcctggaaacaaacagagccagcagaacagaagctcaacagtgtgtggattatgccacaacagtctgcggggcttgaagagtcagcccctgataccatcccccccaaagagagtggcgttgcttactatgtggacctgcatggacatgcttccaaaaggggctgcttcatgtacggaaacagctttagtgatgagagcacccaggtggaaaacatgctatatccaaagctcatctccttgaattcagcccacttcgacttccagggctgcaatttctcagagaagaatatgtatgcccgagaccgtagagatggccagtctaaagagggaagcggccgtgttgcaatctacaaagcctcagggataatccacagctacacacttgaatgcaactacaacactggacgctcagtaaacagcatccctgctgcctgccatgacaatgggcgtgccagcccccctcccccgccggctttcccctccagatacactgtggaactatttgagcaggtgggacgagctatggccattgcagccctggacatggcggaatgtaatccgtggccccgaattgtactgtcagagcacagcagccttactaatctacgggcctggatgctgaaacatgtacgcaacagccgaggcctaagcagcactctgaatgtgggtgtcaacaagaagaggggccttcgaactccacccaaaagtcacaatgggttgcctgtctcctgctccgaaaacaccttgagtcgggcacgaagttttagcaccggcacaagtgccggtggtagcagcagcagccaacaaaattctccacagatgaagaattcccccagctttccttttcatggcagtcggcctgcagggctgccaggcctgggctctagtacccaaaaggtcacccaccgggtgctgggccccgtcagaggtaagccagtctgggagcccctgcaacatgtgttcggttgtctggggcattgctgggggaagtaagagcttgaagatatactgttggcccaggaccaaggggtgaatcaataaaattagtttgtagcagaaaaaaaaac

SEQ ID NO: 355054 - DNA, 379 bp, Homo sapiens
cccgggttaactggcatctgcttctttgcagtgggttgcctgtctcctgctccgaaaacaccttgagtcgggcacgaagttttagcaccggcacaagtgccggtggtagcagcagcagccaacaaaattctccacagatgaagaattcccccagctttccttttcatggcagtcggcctgcagggctgccaggcctgggctctagtacccaaaaggtcacccaccgggtgctgggccccgtcagaggtaagccagtctgggagcccctgcaacatgtgttcggttgtctggggcattgctgggggaagtaagagcttgaagatatactgttggcccaggaccaaggggtgaatcaataaaattagtttgtagcagaaaa

SEQ ID NO: 355055 - DNA, 2332 bp, Homo sapiens
ttgtggcaagattctgaggggaagtgtagctcccaggttggttccaagtcttcttccaattaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacacactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggaaaggatgctctgcttttctgtcaatggggttttcaaggaagtggaaggacagtctcagggttctgttctcgccttcacccggaccttcattgctacccctggcagcagttccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgccttcaggacaatgagtggaactacactagagctggccaggccttcactatgctccagaccgagggcaagatccccgcagaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgttgaaaaatgtg

SEQ ID NO: 355056 - DNA, 3199 bp, Homo sapiens
  misc_feature (30)..(30): n is a, c, g, or t
cctgactcacctagctcctcctgcagcatngcgtgttcacttccaagcggggcagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttgatcagtggatccgtttttttctcaaatgctgtttgcttcatggcatgcaggagtctctgctacactttcctggaggcctcattctcattgaaaaggagttggcagaactgggctggaagtttctcaatctgatgcatcataatcagcagagtcatttttcacaaaacgaaatctttccagaagatcacgaataagagagatcaaagctaggcagcttgagttgaagtagagctggaagaaggagttttgaggactgtttcaaaaccactggactagatgatctctaaagtggtgacatggacataggataatggttatagacagtccccctcccaacgggaaaaaatgaaagcaagcaaaaagttaccagctccaagccaacttgaaatccaatcaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagggatgatgcttcctgtctgtcacaaggctgagtgaacacaacatgcctgtaggtccagaacattcttcctacagagaccagatgtccagaaagccctatctgctggattcagggaacgcctctcctcatttctgtcacactatttgcaaaagcctccttctctgagatcttcaaagctgcagttctagccacagtctgcagggagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacagtaagtgaccaggcagcctggtttgcacgtagcagcccccgggactgtgcaaccctttcattctctgtggtcttccttttcttctctcattagagaactgacgaatgctggaagtggaatagtggctgagcaatcctaattgtagccctggcgtcagtgagtggagcatgtataggagactttcttagatttaatggatacccgccttctctcctcttccccacagcactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggtgccttcaggacaatgagtggaactacactagagctggccaggccttcactatgctccagaccgagggcaagatccccgcagaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgttgaaaaatgtg

SEQ ID NO: 355057 - DNA, 2894 bp, Homo sapiens
cctcctcctctgggatcttgaaaacgtagaattcccagagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttggagtctctgctacactttcctggaggcctcattctcattgaaaaggagttggcagaactgggctggaagtttctcaatctgatgcatcataatcagcagagtcatttttcacaaaacgaaatctttccagaagatcacgaataagagagatcaaagctaggcagcttgagttgaagtagagctggaagaaggagttttgaggactgtttcaaaaccactggactagatgatctctaaaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacacactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggaaaggatgctctgcttttctgtcaatggggttttcaaggaagtggaaggacagtctcagggttctgttctcgccttcacccggaccttcattgctacccctggcagcagttccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgccttcaggacaatgagtggaactacactagagctggccaggccttcactatgctccagaccgagggcaagatccccgcagaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgttgaaaaatgtg

SEQ ID NO: 355058 - DNA, 2433 bp, Homo sapiens
  misc_feature (30)..(30): n is a, c, g, or t
cctgactcacctagctcctcctgcagcatngcgtgttcacttccaagcggggcagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttggagtctctgctacactttcctggaggcctcattctcattgaaaaggagttggcagaactgggctggaagtttctcaatctgatgcatcataatcagcagagtcatttttcacaaaacgaaatctttccagaagatcacgaataagagagatcaaagctaggcagcttgagttgaagtagagctggaagaaggagttttgaggactgtttcaaaaccactggactagatgatctctaaaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacacactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctaccgagggcaagatccccgcagaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgttgaaaaatgtg

SEQ ID NO: 355059 - DNA, 1036 bp, Homo sapiens
aaagaattcggcacgagcacaatggaggactccggaaagactttcagctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcgcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcggggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggtcagtaccttctaataaacctctcgctggcggggagaacccgcctgccccaggcaagagacactcac

SEQ ID NO: 355060 - DNA, 3264 bp, Homo sapiens
gtggggcagaagccgggacccttacgagaagctgctgttctgagcgcccgaccggcgtggcttgcgggctctagcgttaccattgcatccaggaccaggcaatggcacaccagaggagtagtcgatcgtcctgtccccctggttctatcaataatggaggactccggaaagactttcagctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcgcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcggggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggttggacacgagttgccgctggttgtccaaatcaacaaccaggtcgtccagctcctgctgaagcctgttcttggtcttttccagtttatcatacgcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgaatggcccctgtccctggccccacagactctgagaagcgaagaccatgtctcctcgttggagaaacccaatagcaggggaagctggggggtcaagcaccatcgcaccaacactccaccgcgatctgcctgcgggggatctcagcgcagagaagttgagaggacccatgaaggaagcaaggacacggggcaggcacctggatgttgagagtggagatgtggcgctccaggttctgcttggcctccatctcctcgtccagctggtcttgcaggctgttccgctcctcctccagctggcgcagcttcgtagacacgttgagcttctgccgggtttcttcttgaagcagctcctgcaaaagggatgcaaagaggtcccagggacctgccccgaggaaggccaccccccaggtcccctggatgatgtggcaggacactcacctgggtgtcctggagctgggaactgagggacgccacgtccttggccagcttaatggccttcccctcggcctcgttaagcatccctgtgacgctctcaacttcattctaagggtgccaagagactggttagtcaaagcctctagaaggggatcctcgttgaaaggagccctttttactcaaaacacatgggctagtacttgaggtgttcactgattgagaaaatacccgtgaggtatgggactctgataaaaaaaaaaacacacacacacacaaaaaaaacagaatctgtggcttgaagggaactccgtcacctatgagttgggaccctggccctagactctgtggttctaagaacttatttgagccccaatggtattgactgggacctgatcccactaaatggatcctagatccctgccaaggttggtagagacaaagcagcaggtctgagagtccagacgaggtgctctggctggtccactctctaaggctggagaagggagaccaggatggtacttgaacgtcccagggatgctgtcccatcccttccttcctcactcctactctttgaccctgatggccaaagccagagacgcaggccctaaaggtaaaaacgtcctctctgtattctctggcttttactccctagtgtctctgcataagtccctttgaggctgttagcctacccctccatctcttccattgacaaggaggatatgaatgatcttgacactgcttatatgagggcggcaaaagccctgctctcaactgcatgtgagaaaaaaacatctcacttaattcttccctcgccccttggtccctggctgtggacatgttaaacatttgtgaaaactttggccacgtccccatgagtggcaaggcagggtaaatggctatgccaagtgaaagaagaccaaagacaaaaagaccatgtcattcagcagcttaaaacccctcaacagcttcacattgcccagagtaaggatcaacatacatgtaataggttctcaaaagccctacatcatctgggtacaagctccccctccaaccccactctgtactatctccccctacccccaaccccagctgggcactccagctctactggctgtatgtctctctcctaatttttctacttaccacagggcctttgcacacgctgttccctctgcctggtagacttatccatgctccttagggaagcctttcgtggctcctcctcccccaggttaggccccctggttatttacacttgggcatcatgtgccttccctttgctgcatcatttgacattcatttgtgtgattattcatgtctttcccttcccttcccttccccttactcggctggagtcctactggggcagcgacagtgtctcttcttccttgctgttggatctcaggattaagcacagtgcctggcatacagcaggtgctcaataaatacttatcaaattgaaaaaagaag

SEQ ID NO: 355061 - DNA, 3352 bp, Homo sapiens
ggccggggccgcaccgcccttcgcagccgcctctgccgccgccgccgcgttggcctcgccgcccctgctcggacaccatgccacaaggagagtgatctcttcccctgttttcacaatggaggactccggaaagactttcagctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcgcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcggggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggttggggaagcgcctggaatttgggaagccgccttcacacatgtcttcatcgccgctgccgtcagcccagggggtagtcaagatgttgctttaggaaaaccacggaagctgaaggtcttggtgttggttggacacgagttgccgctggttgtccaaatcaacaaccaggtcgtccagctcctgctgaagcctgttcttggtcttttccagtttatcatacgcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgaatggcccctgtccctggccccacagactctgagaagcgaagaccatgtctcctcgttggagaaacccaatagcaggggaagctggggggtcaagcaccatcgcaccaacactccaccgcgatctgcctgcgggggatctcagcgcagagaagttgagaggacccatgaaggaagcaaggacacggggcaggcacctggatgttgagagtggagatgtggcgctccaggttctgcttggcctccatctcctcgtccagctggtcttgcaggctgttccgctcctcctccagctggcgcagcttcgtagacacgttgagcttctgccgggtttcttcttgaagcagctcctgcaaaagggatgcaaagaggtcccagggacctgccccgaggaaggccaccccccaggtcccctggatgatgtggcaggacactcacctgggtgtcctggagctgggaactgagggacgccacgtccttggccagcttaatggccttcccctcggcctcgttaagcatccctgtgacgctctcaacttcattctaagggtgccaagagactggttagtcaaagcctctagaaggggatcctcgttgaaaggagccctttttactcaaaacacatgggctagtacttgaggtgttcactgattgagaaaatacccgtgaggtatgggactctgataaaaaaaaaaacacacacacacacaaaaaaaacagaatctgtggcttgaagggaactccgtcacctatgagttgggaccctggccctagactctgtggttctaagaacttatttgagccccaatggtattgactgggacctgatcccactaaatggatcctagatccctgccaaggttggtagagacaaagcagcaggtctgagagtccagacgaggtgctctggctggtccactctctaaggctggagaagggagaccaggatggtacttgaacgtcccagggatgctgtcccatcccttccttcctcactcctactctttgaccctgatggccaaagccagagacgcaggccctaaaggtaaaaacgtcctctctgtattctctggcttttactccctagtgtctctgcataagtccctttgaggctgttagcctacccctccatctcttccattgacaaggaggatatgaatgatcttgacactgcttatatgagggcggcaaaagccctgctctcaactgcatgtgagaaaaaaacatctcacttaattcttccctcgccccttggtccctggctgtggacatgttaaacatttgtgaaaactttggccacgtccccatgagtggcaaggcagggtaaatggctatgccaagtgaaagaagaccaaagacaaaaagaccatgtcattcagcagcttaaaacccctcaacagcttcacattgcccagagtaaggatcaacatacatgtaataggttctcaaaagccctacatcatctgggtacaagctccccctccaaccccactctgtactatctccccctacccccaaccccagctgggcactccagctctactggctgtatgtctctctcctaatttttctacttaccacagggcctttgcacacgctgttccctctgcctggtagacttatccatgctccttagggaagcctttcgtggctcctcctcccccaggttaggccccctggttatttacacttgggcatcatgtgccttccctttgctgcatcatttgacattcatttgtgtgattattcatgtctttcccttcccttcccttccccttactcggctggagtcctactggggcagcgacagtgtctcttcttccttgctgttggatctcaggattaagcacagtgcctggcatacagcaggtgctcaataaatacttatcaaattgaaaaaagaag

SEQ ID NO: 355062 - DNA, 3484 bp, Homo sapiens
ggccggggccgcaccgcccttcgcagccgcctctgccgccgccgccgcgttggcctcgccgcccctgctcggacaccatgccacaaggagagtgatctcttcccctgttttcacaatggaggactccggaaagactttcagctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcgcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcggggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggagagaaaattgagaccctgtgagaccctgctcctgactcttgatgttcacccttataactctctgggccccggtgctagccagtttgtcacagctgttatgtcagcttaatttggtttgctctgtctgaaggttggggaagcgcctggaatttgggaagccgccttcacacatgtcttcatcgccgctgccgtcagcccagggggtagtcaagatgttgctttaggaaaaccacggaagctgaaggtcttggtgttggttggacacgagttgccgctggttgtccaaatcaacaaccaggtcgtccagctcctgctgaagcctgttcttggtcttttccagtttatcatacgcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgaatggcccctgtccctggccccacagactctgagaagcgaagaccatgtctcctcgttggagaaacccaatagcaggggaagctggggggtcaagcaccatcgcaccaacactccaccgcgatctgcctgcgggggatctcagcgcagagaagttgagaggacccatgaaggaagcaaggacacggggcaggcacctggatgttgagagtggagatgtggcgctccaggttctgcttggcctccatctcctcgtccagctggtcttgcaggctgttccgctcctcctccagctggcgcagcttcgtagacacgttgagcttctgccgggtttcttcttgaagcagctcctgcaaaagggatgcaaagaggtcccagggacctgccccgaggaaggccaccccccaggtcccctggatgatgtggcaggacactcacctgggtgtcctggagctgggaactgagggacgccacgtccttggccagcttaatggccttcccctcggcctcgttaagcatccctgtgacgctctcaacttcattctaagggtgccaagagactggttagtcaaagcctctagaaggggatcctcgttgaaaggagccctttttactcaaaacacatgggctagtacttgaggtgttcactgattgagaaaatacccgtgaggtatgggactctgataaaaaaaaaaacacacacacacacaaaaaaaacagaatctgtggcttgaagggaactccgtcacctatgagttgggaccctggccctagactctgtggttctaagaacttatttgagccccaatggtattgactgggacctgatcccactaaatggatcctagatccctgccaaggttggtagagacaaagcagcaggtctgagagtccagacgaggtgctctggctggtccactctctaaggctggagaagggagaccaggatggtacttgaacgtcccagggatgctgtcccatcccttccttcctcactcctactctttgaccctgatggccaaagccagagacgcaggccctaaaggtaaaaacgtcctctctgtattctctggcttttactccctagtgtctctgcataagtccctttgaggctgttagcctacccctccatctcttccattgacaaggaggatatgaatgatcttgacactgcttatatgagggcggcaaaagccctgctctcaactgcatgtgagaaaaaaacatctcacttaattcttccctcgccccttggtccctggctgtggacatgttaaacatttgtgaaaactttggccacgtccccatgagtggcaaggcagggtaaatggctatgccaagtgaaagaagaccaaagacaaaaagaccatgtcattcagcagcttaaaacccctcaacagcttcacattgcccagagtaaggatcaacatacatgtaataggttctcaaaagccctacatcatctgggtacaagctccccctccaaccccactctgtactatctccccctacccccaaccccagctgggcactccagctctactggctgtatgtctctctcctaatttttctacttaccacagggcctttgcacacgctgttccctctgcctggtagacttatccatgctccttagggaagcctttcgtggctcctcctcccccaggttaggccccctggttatttacacttgggcatcatgtgccttccctttgctgcatcatttgacattcatttgtgtgattattcatgtctttcccttcccttcccttccccttactcggctggagtcctactggggcagcgacagtgtctcttcttccttgctgttggatctcaggattaagcacagtgcctggcatacagcaggtgctcaataaatacttatcaaattgaaaaaagaag

SEQ ID NO: 355063 - DNA, 3308 bp, Homo sapiens
ggccggggccgcaccgcccttcgcagccgcctctgccgccgccgccgcgttggcctcgccgcccctgctcggacaccatgccacaaggagagtgatctcttcccctgttttcacaatggaggactccggaaagactttcagctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggttccgaggagatctctcaatcgccagtgcagtcggtggagcccactcgctgcgtcctcctggagcctgcgtttgaatttaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcgcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcggggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggttggacacgagttgccgctggttgtccaaatcaacaaccaggtcgtccagctcctgctgaagcctgttcttggtcttttccagtttatcatacgcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgaatggcccctgtccctggccccacagactctgagaagcgaagaccatgtctcctcgttggagaaacccaatagcaggggaagctggggggtcaagcaccatcgcaccaacactccaccgcgatctgcctgcgggggatctcagcgcagagaagttgagaggacccatgaaggaagcaaggacacggggcaggcacctggatgttgagagtggagatgtggcgctccaggttctgcttggcctccatctcctcgtccagctggtcttgcaggctgttccgctcctcctccagctggcgcagcttcgtagacacgttgagcttctgccgggtttcttcttgaagcagctcctgcaaaagggatgcaaagaggtcccagggacctgccccgaggaaggccaccccccaggtcccctggatgatgtggcaggacactcacctgggtgtcctggagctgggaactgagggacgccacgtccttggccagcttaatggccttcccctcggcctcgttaagcatccctgtgacgctctcaacttcattctaagggtgccaagagactggttagtcaaagcctctagaaggggatcctcgttgaaaggagccctttttactcaaaacacatgggctagtacttgaggtgttcactgattgagaaaatacccgtgaggtatgggactctgataaaaaaaaaaacacacacacacacaaaaaaaacagaatctgtggcttgaagggaactccgtcacctatgagttgggaccctggccctagactctgtggttctaagaacttatttgagccccaatggtattgactgggacctgatcccactaaatggatcctagatccctgccaaggttggtagagacaaagcagcaggtctgagagtccagacgaggtgctctggctggtccactctctaaggctggagaagggagaccaggatggtacttgaacgtcccagggatgctgtcccatcccttccttcctcactcctactctttgaccctgatggccaaagccagagacgcaggccctaaaggtaaaaacgtcctctctgtattctctggcttttactccctagtgtctctgcataagtccctttgaggctgttagcctacccctccatctcttccattgacaaggaggatatgaatgatcttgacactgcttatatgagggcggcaaaagccctgctctcaactgcatgtgagaaaaaaacatctcacttaattcttccctcgccccttggtccctggctgtggacatgttaaacatttgtgaaaactttggccacgtccccatgagtggcaaggcagggtaaatggctatgccaagtgaaagaagaccaaagacaaaaagaccatgtcattcagcagcttaaaacccctcaacagcttcacattgcccagagtaaggatcaacatacatgtaataggttctcaaaagccctacatcatctgggtacaagctccccctccaaccccactctgtactatctccccctacccccaaccccagctgggcactccagctctactggctgtatgtctctctcctaatttttctacttaccacagggcctttgcacacgctgttccctctgcctggtagacttatccatgctccttagggaagcctttcgtggctcctcctcccccaggttaggccccctggttatttacacttgggcatcatgtgccttccctttgctgcatcatttgacattcatttgtgtgattattcatgtctttcccttcccttcccttccccttactcggctggagtcctactggggcagcgacagtgtctcttcttccttgctgttggatctcaggattaagcacagtgcctggcatacagcaggtgctcaataaatacttatcaaattgaaaaaagaag

SEQ ID NO: 355064 - DNA, 3200 bp, Homo sapiens
ggccggggccgcaccgcccttcgcagccgcctctgccgccgccgccgcgttggcctcgccgcccctgctcggacaccatgccacaaggagagtgatctcttcccctgttttcacaatggaggactccggaaagactttcagctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcgcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcggggttggggaagcgcctggaatttgggaagccgccttcacacatgtcttcatcgccgctgccgtcagcccagggggtagtcaagatgttgctttaggaaaaccacggaagctgaaggtcttggtgttggttggacacgagttgccgctggttgtccaaatcaacaaccaggtcgtccagctcctgctgaagcctgttcttggtcttttccagtttatcatacgcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgaatggcccctgtccctggccccacagactctgagaagcgaagaccatgtctcctcgttggagaaacccaatagcaggggaagctggggggtcaagcaccatcgcaccaacactccaccgcgatctgcctgcgggggatctcagcgcagagaagttgagaggacccatgaaggaagcaaggacacggggcaggcacctggatgttgagagtggagatgtggcgctccaggttctgcttggcctccatctcctcgtccagctggtcttgcaggctgttccgctcctcctccagctggcgcagcttcgtagacacgttgagcttctgccgggtttcttcttgaagcagctcctgcaaaagggatgcaaagaggtcccagggacctgccccgaggaaggccaccccccaggtcccctggatgatgtggcaggacactcacctgggtgtcctggagctgggaactgagggacgccacgtccttggccagcttaatggccttcccctcggcctcgttaagcatccctgtgacgctctcaacttcattctaagggtgccaagagactggttagtcaaagcctctagaaggggatcctcgttgaaaggagccctttttactcaaaacacatgggctagtacttgaggtgttcactgattgagaaaatacccgtgaggtatgggactctgataaaaaaaaaaacacacacacacacaaaaaaaacagaatctgtggcttgaagggaactccgtcacctatgagttgggaccctggccctagactctgtggttctaagaacttatttgagccccaatggtattgactgggacctgatcccactaaatggatcctagatccctgccaaggttggtagagacaaagcagcaggtctgagagtccagacgaggtgctctggctggtccactctctaaggctggagaagggagaccaggatggtacttgaacgtcccagggatgctgtcccatcccttccttcctcactcctactctttgaccctgatggccaaagccagagacgcaggccctaaaggtaaaaacgtcctctctgtattctctggcttttactccctagtgtctctgcataagtccctttgaggctgttagcctacccctccatctcttccattgacaaggaggatatgaatgatcttgacactgcttatatgagggcggcaaaagccctgctctcaactgcatgtgagaaaaaaacatctcacttaattcttccctcgccccttggtccctggctgtggacatgttaaacatttgtgaaaactttggccacgtccccatgagtggcaaggcagggtaaatggctatgccaagtgaaagaagaccaaagacaaaaagaccatgtcattcagcagcttaaaacccctcaacagcttcacattgcccagagtaaggatcaacatacatgtaataggttctcaaaagccctacatcatctgggtacaagctccccctccaaccccactctgtactatctccccctacccccaaccccagctgggcactccagctctactggctgtatgtctctctcctaatttttctacttaccacagggcctttgcacacgctgttccctctgcctggtagacttatccatgctccttagggaagcctttcgtggctcctcctcccccaggttaggccccctggttatttacacttgggcatcatgtgccttccctttgctgcatcatttgacattcatttgtgtgattattcatgtctttcccttcccttcccttccccttactcggctggagtcctactggggcagcgacagtgtctcttcttccttgctgttggatctcaggattaagcacagtgcctggcatacagcaggtgctcaataaatacttatcaaattgaaaaaagaag

SEQ ID NO: 355065 - DNA, 2844 bp, Homo sapiens
ggccggggccgcaccgcccttcgcagccgcctctgccgccgccgccgcgttggcctcgccgcccctgctcggacaccatgccacaaggagagtgatctcttcccctgttttcacaatggaggactccggaaagactttcagctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcgcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcggggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggttggggaagcgcctggaatttgggaagccgccttcacacatgtcttcatcgccgctgccgtcagcccagggggtagtcaagatgttgctttaggaaaaccacggaagctgaaggtcttggtgttggtgcggaagtcgttaccttttgtcgtctttttacactaggtttttgttttaagttagtttgagaaataagagcagtcaccatagttagttagctttgcggcccaagccaatgaccgaggccatcacctgtgctctggggtttgtccctgggaaatgtcttttcatccttacctgccaccgtgtgcattgcaaagagggacaaaaggggctctctgggaagggctctaagttgtcggtgatgaggctaccgtgttgtttttgagatagagtcttgctctgtcacccaggctggagtgtggtggcgtgatctcagctcactgcaacctccgcctcctgggttcaaacggttcttgttcctgagtcttccaggtagctgggattacaggcacccaccaccacacctggctgaattttttgtatttttaatagagacggggttttgccatgttgcccagtgtggtcttgaactcctggcctcaagtgatcctcccatctcggcctcccagaatgctgggatttcaagcatgagccatcgttcccatgccccattgtgttgcactaacccaagcggaggtcctgattggtcttttttttttttttcttttttggagacagagtcttggctcttgccctgtcttgtccagggctggagtgtagtgggtggcaatttcgggctcaccgcagcctccgcctcctaggttcaagcgattctcttatctcagcttcccaagtagctgggactacgggagtgtgccactacacccactaattttggtatttttagtgagaaaccccatctctactaaaaatacaaaaaattagctgggtgcagtggtgcgtgcctataattccagctactccagatgttgaggcaggagagttgcttggacccgggaggtggagggtgcagtgagccgggatcgcgctactgtactccagcctgggcaacagagtgagactccgtctccaaaaaaaaaaaaaagggtgtcataaacctctgagactgtagcctgcttcttagcttctcattgagattcctagaggtgcgttcgagttttcagagtaattttccagaccaaccagcgtcagtgggaaatctgacctcttttggcaaactgcgatcattcattttcctgagtcccctggtggggtggggggaattctgcctcaggaccctgaggggtctttggggcaagatggccttggtaatgcagccactaagaacaggacttcattcaaaggcataatgaagtaaccagggtgaccatcaagtaaaattaaagcacaagatcattgtaggaggcttccttgtcaaagacgtgaacgtgggatttccaacgcaccacggtgtgtccactcatcactgcatgttaggaactgctgtctctttgggacacgagttaaaagaacacactaatttctggagtgtgcctgcagcttcacggccttcattttgttactaagttattttctggaagaacagcaaaaatttcaggttgaaaacagaactttccaagtgctactgaaattccgcagagaattacgctgcgatggtgggtttcttaccctagaaacatcctaacctgtatccacagaagatgtccttttatttttttaaaagatcaataaaatcaagagaaacgaaaaaaaaaaaag

SEQ ID NO: 355066 - DNA, 3266 bp, Homo sapiens
ggccggggccgcaccgcccttcgcagccgcctctgccgccgccgccgcgttggcctcgccgcccctgctcggacaccatgccacaaggagagtgatctcttcccctgttttcacaatggaggactccggaaagactttcagctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcgcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcggggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggttggggaagcgcctggaatttgggaagccgccttcacacatgtcttcatcgccgctgccgtcagcccagggggtagtcaagatgttgctttaggaaaaccacggaagctgaaggtcttggtgttggtgcggaagtcgttaccttttgtcgtctttttacactaggtttttgttttaagttagtttgagaaataagagcagtcaccatagttagttagctttgcggcccaagccaatgaccgaggccatcacctgtgctctggggtttgtccctgggaaatgtcttttcatccttacctgccaccgtgtgcattgcaaagagggacaaaaggggctctctgggaagggctctaagttgtcggtgatgaggctaccgtgttgtttttgagatagagtcttgctctgtcacccaggctggagtgtggtggcgtgatctcagctcactgcaacctccgcctcctgggttcaaacggttcttgttcctgagtcttccaggtagctgggattacaggcacccaccaccacacctggctgaattttttgtatttttaatagagacggggttttgccatgttgcccagtgtggtcttgaactcctggcctcaagtgatcctcccatctcggcctcccagaatgctgggatttcaagcatgagccatcgttcccatgccccattgtgttgcactaacccaagcggaggtcctgattggtcttttttttttttttcttttttggagacagagtcttggctcttgccctgtcttgtccagggctggagtgtagtgggtggcaatttcgggctcaccgcagcctccgcctcctaggttcaagcgattctcttatctcagcttcccaagtagctgggactacgggagtgtgccactacacccactaattttggtatttttagtgagaaacggggtttcaccatgttggccatgctggtcttgaactcccggcctcgagtgatcctcccgcctcagcctcccagagtgctggaattacaggcctgagccaccgtgcctggcccctgattggtcttgacaggtgtttttaatgtcccaagtctccgtaaatgtgggatggagcttctctcagaggctcttccccccaactcccaaccaggtggaatcgtcttccagaacaaaatctcccagtgctttgtggtgtactgaaatcatgtctaagaacagagaacttaacagtcacatgcctttttaaaaactggaataggctgggcgcggtggctcaggccggtaatcctaagactttggaaggccgaggcgggtggattacctgaggtcaggagttcaagaccagcctggccaacatggtgaaaccccatctctactaaaaatacaaaaaattagctgggtgcagtggtgcgtgcctataattccagctactccagatgttgaggcaggagagttgcttggacccgggaggtggagggtgcagtgagccgggatcgcgctactgtactccagcctgggcaacagagtgagactccgtctccaaaaaaaaaaaaaagggtgtcataaacctctgagactgtagcctgcttcttagcttctcattgagattcctagaggtgcgttcgagttttcagagtaattttccagaccaaccagcgtcagtgggaaatctgacctcttttggcaaactgcgatcattcattttcctgagtcccctggtggggtggggggaattctgcctcaggaccctgaggggtctttggggcaagatggccttggtaatgcagccactaagaacaggacttcattcaaaggcataatgaagtaaccagggtgaccatcaagtaaaattaaagcacaagatcattgtaggaggcttccttgtcaaagacgtgaacgtgggatttccaacgcaccacggtgtgtccactcatcactgcatgttaggaactgctgtctctttgggacacgagttaaaagaacacactaatttctggagtgtgcctgcagcttcacggccttcattttgttactaagttattttctggaagaacagcaaaaatttcaggttgaaaacagaactttccaagtgctactgaaattccgcagagaattacgctgcgatggtgggtttcttaccctagaaacatcctaacctgtatccacagaagatgtccttttatttttttaaaagatcaataaaatcaagagaaacgaaaaaaaaaaaag

SEQ ID NO: 355067 - DNA, 2596 bp, Homo sapiens
tgcatccatacggaaagtcggggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggagagaaaattgagaccctgtgagaccctgctcctgactcttgatgttcacccttataactctctgggccccggtgctagccagtttgtcacagctgttatgtcagcttaatttggtttgctctgtctgaaggttggggaagcgcctggaatttgggaagccgccttcacacatgtcttcatcgccgctgccgtcagcccagggggtagtcaagatgttgctttaggaaaaccacggaagctgaaggtcttggtgttggttggacacgagttgccgctggttgtccaaatcaacaaccaggtcgtccagctcctgctgaagcctgttcttggtcttttccagtttatcatacgcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgaatggcccctgtccctggccccacagactctgagaagcgaagaccatgtctcctcgttggagaaacccaatagcaggggaagctggggggtcaagcaccatcgcaccaacactccaccgcgatctgcctgcgggggatctcagcgcagagaagttgagaggacccatgaaggaagcaaggacacggggcaggcacctggatgttgagagtggagatgtggcgctccaggttctgcttggcctccatctcctcgtccagctggtcttgcaggctgttccgctcctcctccagctggcgcagcttcgtagacacgttgagcttctgccgggtttcttcttgaagcagctcctgcaaaagggatgcaaagaggtcccagggacctgccccgaggaaggccaccccccaggtcccctggatgatgtggcaggacactcacctgggtgtcctggagctgggaactgagggacgccacgtccttggccagcttaatggccttcccctcggcctcgttaagcatccctgtgacgctctcaacttcattctaagggtgccaagagactggttagtcaaagcctctagaaggggatcctcgttgaaaggagccctttttactcaaaacacatgggctagtacttgaggtgttcactgattgagaaaatacccgtgaggtatgggactctgataaaaaaaaaaacacacacacacacaaaaaaaacagaatctgtggcttgaagggaactccgtcacctatgagttgggaccctggccctagactctgtggttctaagaacttatttgagccccaatggtattgactgggacctgatcccactaaatggatcctagatccctgccaaggttggtagagacaaagcagcaggtctgagagtccagacgaggtgctctggctggtccactctctaaggctggagaagggagaccaggatggtacttgaacgtcccagggatgctgtcccatcccttccttcctcactcctactctttgaccctgatggccaaagccagagacgcaggccctaaaggtaaaaacgtcctctctgtattctctggcttttactccctagtgtctctgcataagtccctttgaggctgttagcctacccctccatctcttccattgacaaggaggatatgaatgatcttgacactgcttatatgagggcggcaaaagccctgctctcaactgcatgtgagaaaaaaacatctcacttaattcttccctcgccccttggtccctggctgtggacatgttaaacatttgtgaaaactttggccacgtccccatgagtggcaaggcagggtaaatggctatgccaagtgaaagaagaccaaagacaaaaagaccatgtcattcagcagcttaaaacccctcaacagcttcacattgcccagagtaaggatcaacatacatgtaataggttctcaaaagccctacatcatctgggtacaagctccccctccaaccccactctgtactatctccccctacccccaaccccagctgggcactccagctctactggctgtatgtctctctcctaatttttctacttaccacagggcctttgcacacgctgttccctctgcctggtagacttatccatgctccttagggaagcctttcgtggctcctcctcccccaggttaggccccctggttatttacacttgggcatcatgtgccttccctttgctgcatcatttgacattcatttgtgtgattattcatgtctttcccttcccttcccttccccttactcggctggagtcctactggggcagcgacagtgtctcttcttccttgctgttggatctcaggattaagcacagtgcctggcatacagcaggtgctcaataaatacttatcaaattgaaaaaagaag

SEQ ID NO: 355068 - DNA, 2230 bp, Homo sapiens
  misc_feature (4)..(4): n is a, c, g, or t
  misc_feature (24)..(24): n is a, c, g, or t
  misc_feature (33)..(33): n is a, c, g, or t
aagntaggctaggtagaggctggngtgaatcgnccgaggggtaaagtgaacttgtatgaataagagaatctcctggtagatcggttcagagaactgaagggatgaaatgccatgagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggttggggaagcgcctggaatttgggaagccgccttcacacatgtcttcatcgccgctgccgtcagcccagggggtagtcaagatgttgctttaggaaaaccacggaagctgaaggtcttggtgttggtgcggaagtcgttaccttttgtcgtctttttacactaggtttttgttttaagttagtttgagaaataagagcagtcaccatagttagttagctttgcggcccaagccaatgaccgaggccatcacctgtgctctggggtttgtccctgggaaatgtcttttcatccttacctgccaccgtgtgcattgcaaagagggacaaaaggggctctctgggaagggctctaagttgtcggtgatgaggctaccgtgttgtttttgagatagagtcttgctctgtcacccaggctggagtgtggtggcgtgatctcagctcactgcaacctccgcctcctgggttcaaacggttcttgttcctgagtcttccaggtagctgggattacaggcacccaccaccacacctggctgaattttttgtatttttaatagagacggggttttgccatgttgcccagtgtggtcttgaactcctggcctcaagtgatcctcccatctcggcctcccagaatgctgggatttcaagcatgagccatcgttcccatgccccattgtgttgcactaacccaagcggaggtcctgattggtcttttttttttttttcttttttggagacagagtcttggctcttgccctgtcttgtccagggctggagtgtagtgggtggcaatttcgggctcaccgcagcctccgcctcctaggttcaagcgattctcttatctcagcttcccaagtagctgggactacgggagtgtgccactacacccactaattttggtatttttagtgagaaaccccatctctactaaaaatacaaaaaattagctgggtgcagtggtgcgtgcctataattccagctactccagatgttgaggcaggagagttgcttggacccgggaggtggagggtgcagtgagccgggatcgcgctactgtactccagcctgggcaacagagtgagactccgtctccaaaaaaaaaaaaaagggtgtcataaacctctgagactgtagcctgcttcttagcttctcattgagattcctagaggtgcgttcgagttttcagagtaattttccagaccaaccagcgtcagtgggaaatctgacctcttttggcaaactgcgatcattcattttcctgagtcccctggtggggtggggggaattctgcctcaggaccctgaggggtctttggggcaagatggccttggtaatgcagccactaagaacaggacttcattcaaaggcataatgaagtaaccagggtgaccatcaagtaaaattaaagcacaagatcattgtaggaggcttccttgtcaaagacgtgaacgtgggatttccaacgcaccacggtgtgtccactcatcactgcatgttaggaactgctgtctctttgggacacgagttaaaagaacacactaatttctggagtgtgcctgcagcttcacggccttcattttgttactaagttattttctggaagaacagcaaaaatttcaggttgaaaacagaactttccaagtgctactgaaattccgcagagaattacgctgcgatggtgggtttcttaccctagaaacatcctaacctgtatccacagaagatgtccttttatttttttaaaagatcaataaaatcaagagaaacgaaaaaaaaaaaag

SEQ ID NO: 355069 - DNA, 1542 bp, Homo sapiens
  misc_feature (4)..(4): n is a, c, g, or t
  misc_feature (24)..(24): n is a, c, g, or t
  misc_feature (33)..(33): n is a, c, g, or t
aagntaggctaggtagaggctggngtgaatcgnccgaggatgtcttttcatccttacctgccaccgtgtgcattgcaaagagggacaaaaggggctctctgggaagggctctaagttgtcggtgatgaggctaccgtgttgtttttgagatagagtcttgctctgtcacccaggctggagtgtggtggcgtgatctcagctcactgcaacctccgcctcctgggttcaaacggttcttgttcctgagtcttccaggtagctgggattacaggcacccaccaccacacctggctgaattttttgtatttttaatagagacggggttttgccatgttgcccagtgtggtcttgaactcctggcctcaagtgatcctcccatctcggcctcccagaatgctgggatttcaagcatgagccatcgttcccatgccccattgtgttgcactaacccaagcggaggtcctgattggtcttttttttttttttcttttttggagacagagtcttggctcttgccctgtcttgtccagggctggagtgtagtgggtggcaatttcgggctcaccgcagcctccgcctcctaggttcaagcgattctcttatctcagcttcccaagtagctgggactacgggagtgtgccactacacccactaattttggtatttttagtgagaaaccccatctctactaaaaatacaaaaaattagctgggtgcagtggtgcgtgcctataattccagctactccagatgttgaggcaggagagttgcttggacccgggaggtggagggtgcagtgagccgggatcgcgctactgtactccagcctgggcaacagagtgagactccgtctccaaaaaaaaaaaaaagggtgtcataaacctctgagactgtagcctgcttcttagcttctcattgagattcctagaggtgcgttcgagttttcagagtaattttccagaccaaccagcgtcagtgggaaatctgacctcttttggcaaactgcgatcattcattttcctgagtcccctggtggggtggggggaattctgcctcaggaccctgaggggtctttggggcaagatggccttggtaatgcagccactaagaacaggacttcattcaaaggcataatgaagtaaccagggtgaccatcaagtaaaattaaagcacaagatcattgtaggaggcttccttgtcaaagacgtgaacgtgggatttccaacgcaccacggtgtgtccactcatcactgcatgttaggaactgctgtctctttgggacacgagttaaaagaacacactaatttctggagtgtgcctgcagcttcacggccttcattttgttactaagttattttctggaagaacagcaaaaatttcaggttgaaaacagaactttccaagtgctactgaaattccgcagagaattacgctgcgatggtgggtttcttaccctagaaacatcctaacctgtatccacagaagatgtccttttatttttttaaaagatcaataaaatcaagagaaacgaaaaaaaaaaaag

SEQ ID NO: 355070 - DNA, 1545 bp, Homo sapiens
gtggggcagaagccgggacccttacgagaagctgctgttctgagcgcccgaccggcgtggcttgcgggctctagcgttaccattgcatccaggaccaggcaatggcacaccagaggagtagtcgatcgtcctgtccccctggttctatcaataatggaggactccggaaagactttcagctccgaggaggaagaagctaactattggaaagatctggcgatgacctacaaacagagggcagaaaatacgcaagaggaactccgagaattccaggagggaagccgagaatatgaagtgaattttttgtatttttaatagagacggggttttgccatgttgcccagtgtggtcttgaactcctggcctcaagtgatcctcccatctcggcctcccagaatgctgggatttcaagcatgagccatcgttcccatgccccattgtgttgcactaacccaagcggaggtcctgattggtcttttttttttttttcttttttggagacagagtcttggctcttgccctgtcttgtccagggctggagtgtagtgggtggcaatttcgggctcaccgcagcctccgcctcctaggttcaagcgattctcttatctcagcttcccaagtagctgggactacgggagtgtgccactacacccactaattttggtatttttagtgagaaaccccatctctactaaaaatacaaaaaattagctgggtgcagtggtgcgtgcctataattccagctactccagatgttgaggcaggagagttgcttggacccgggaggtggagggtgcagtgagccgggatcgcgctactgtactccagcctgggcaacagagtgagactccgtctccaaaaaaaaaaaaaagggtgtcataaacctctgagactgtagcctgcttcttagcttctcattgagattcctagaggtgcgttcgagttttcagagtaattttccagaccaaccagcgtcagtgggaaatctgacctcttttggcaaactgcgatcattcattttcctgagtcccctggtggggtggggggaattctgcctcaggaccctgaggggtctttggggcaagatggccttggtaatgcagccactaagaacaggacttcattcaaaggcataatgaagtaaccagggtgaccatcaagtaaaattaaagcacaagatcattgtaggaggcttccttgtcaaagacgtgaacgtgggatttccaacgcaccacggtgtgtccactcatcactgcatgttaggaactgctgtctctttgggacacgagttaaaagaacacactaatttctggagtgtgcctgcagcttcacggccttcattttgttactaagttattttctggaagaacagcaaaaatttcaggttgaaaacagaactttccaagtgctactgaaattccgcagagaattacgctgcgatggtgggtttcttaccctagaaacatcctaacctgtatccacagaagatgtccttttatttttttaaaagatcaataaaatcaagagaaacgaaaaaaaaaaaag

SEQ ID NO: 355071 - DNA, 1631 bp, Homo sapiens
agaggtagaccccaggcatcctactatgcttcctgaggcgttctttcttggagctgaccatggtatgacatctgagatttaaacgttttttaatagagtcataaaatccgtgcctagcattgttaaattattagacaatattagtatattaatggtagtttgtattttttttttgagacggagtctcactctgttgcccaggctggagtacagtagcgcgatcttggctcactgcaccctccacctcccgggtccaagcaactctcctgcctcaacatctggagtagctggaattataggcacgcaccactacacccactaattttggtatttttagtgagaaacggggtttcaccatgttggccatgctggtcttgaactcccggcctcgagtgatcctcccgcctcagcctcccagagtgctggaattacaggcctgagccaccgtgcctggcccctgattggtcttgacaggtgtttttaatgtcccaagtctccgtaaatgtgggatggagcttctctcagaggctcttccccccaactcccaaccaggtggaatcgtcttccagaacaaaatctcccagtgctttgtggtgtactgaaatcatgtctaagaacagagaacttaacagtcacatgcctttttaaaaactggaataggctgggcgcggtggctcaggccggtaatcctaagactttggaaggccgaggcgggtggattacctgaggtcaggagttcaagaccagcctggccaacatggtgaaaccccatctctactaaaaatacaaaaaattagctgggtgcagtggtgcgtgcctataattccagctactccagatgttgaggcaggagagttgcttggacccgggaggtggagggtgcagtgagccgggatcgcgctactgtactccagcctgggcaacagagtgagactccgtctccaaaaaaaaaaaaaagggtgtcataaacctctgagactgtagcctgcttcttagcttctcattgagattcctagaggtgcgttcgagttttcagagtaattttccagaccaaccagcgtcagtgggaaatctgacctcttttggcaaactgcgatcattcattttcctgagtcccctggtggggtggggggaattctgcctcaggaccctgaggggtctttggggcaagatggccttggtaatgcagccactaagaacaggacttcattcaaaggcataatgaagtaaccagggtgaccatcaagtaaaattaaagcacaagatcattgtaggaggcttccttgtcaaagacgtgaacgtgggatttccaacgcaccacggtgtgtccactcatcactgcatgttaggaactgctgtctctttgggacacgagttaaaagaacacactaatttctggagtgtgcctgcagcttcacggccttcattttgttactaagttattttctggaagaacagcaaaaatttcaggttgaaaacagaactttccaagtgctactgaaattccgcagagaattacgctgcgatggtgggtttcttaccctagaaacatcctaacctgtatccacagaagatgtccttttatttttttaaaagatcaataaaatcaagagaaacgaaaaaaaaaaaag

SEQ ID NO: 355072 - DNA, 315 bp, Homo sapiens
gctgtgactccaggtggatgtgtgctactgtgtctagccttctcagaagtcttaagtcattcactcagtgtctgtgttgtccttcaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcggtatgggtggaagggaaaagcacgagtgggagactctcctctctgctttttgtccccagcagctgggtactgggccctg

SEQ ID NO: 355073 - DNA, 3226 bp, Homo sapiens
ggccggggccgcaccgcccttcgcagccgcctctgccgccgccgccgcgttggcctcgccgcccctgctcggacaccatgccacaaggagagtgatctcttcccctgttttcacaatggaggactccggaaagactttcagctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcgcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcggggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggttggacacgagttgccgctggttgtccaaatcaacaaccaggtcgtccagctcctgctgaagcctgttcttggtcttttccagtttatcatacgcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgaatggcccctgtccctggccccacagactctgagaagcgaagaccatgtctcctcgttggagaaacccaatagcaggggaagctggggggtcaagcaccatcgcaccaacactccaccgcgatctgcctgcgggggatctcagcgcagagaagttgagaggacccatgaaggaagcaaggacacggggcaggcacctggatgttgagagtggagatgtggcgctccaggttctgcttggcctccatctcctcgtccagctggtcttgcaggctgttccgctcctcctccagctggcgcagcttcgtagacacgttgagcttctgccgggtttcttcttgaagcagctcctgcaaaagggatgcaaagaggtcccagggacctgccccgaggaaggccaccccccaggtcccctggatgatgtggcaggacactcacctgggtgtcctggagctgggaactgagggacgccacgtccttggccagcttaatggccttcccctcggcctcgttaagcatccctgtgacgctctcaacttcattctaagggtgccaagagactggttagtcaaagcctctagaaggggatcctcgttgaaaggagccctttttactcaaaacacatgggctagtacttgaggtgttcactgattgagaaaatacccgtgaggtatgggactctgataaaaaaaaaaacacacacacacacaaaaaaaacagaatctgtggcttgaagggaactccgtcacctatgagttgggaccctggccctagactctgtggttctaagaacttatttgagccccaatggtattgactgggacctgatcccactaaatggatcctagatccctgccaaggttggtagagacaaagcagcaggtctgagagtccagacgaggtgctctggctggtccactctctaaggctggagaagggagaccaggatggtacttgaacgtcccagggatgctgtcccatcccttccttcctcactcctactctttgaccctgatggccaaagccagagacgcaggccctaaaggtaaaaacgtcctctctgtattctctggcttttactccctagtgtctctgcataagtccctttgaggctgttagcctacccctccatctcttccattgacaaggaggatatgaatgatcttgacactgcttatatgagggcggcaaaagccctgctctcaactgcatgtgagaaaaaaacatctcacttaattcttccctcgccccttggtccctggctgtggacatgttaaacatttgtgaaaactttggccacgtccccatgagtggcaaggcagggtaaatggctatgccaagtgaaagaagaccaaagacaaaaagaccatgtcattcagcagcttaaaacccctcaacagcttcacattgcccagagtaaggatcaacatacatgtaataggttctcaaaagccctacatcatctgggtacaagctccccctccaaccccactctgtactatctccccctacccccaaccccagctgggcactccagctctactggctgtatgtctctctcctaatttttctacttaccacagggcctttgcacacgctgttccctctgcctggtagacttatccatgctccttagggaagcctttcgtggctcctcctcccccaggttaggccccctggttatttacacttgggcatcatgtgccttccctttgctgcatcatttgacattcatttgtgtgattattcatgtctttcccttcccttcccttccccttactcggctggagtcctactggggcagcgacagtgtctcttcttccttgctgttggatctcaggattaagcacagtgcctggcatacagcaggtgctcaataaatacttatcaaattgaaaaaagaag

SEQ ID NO: 355074 - DNA, 3285 bp, Homo sapiens
tttattttgagacggagtcttgttcttgtccaggctggagtgcagtggcatgatctcgactcactgcaacctcagtcctccgggttcaagtgattcttctgcctcaccctcctgagtagctgggattacagacaccatgccacaaggagagtgatctcttcccctgttttcacaatggaggactccggaaagactttcagctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcgcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcggggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggttggacacgagttgccgctggttgtccaaatcaacaaccaggtcgtccagctcctgctgaagcctgttcttggtcttttccagtttatcatacgcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgaatggcccctgtccctggccccacagactctgagaagcgaagaccatgtctcctcgttggagaaacccaatagcaggggaagctggggggtcaagcaccatcgcaccaacactccaccgcgatctgcctgcgggggatctcagcgcagagaagttgagaggacccatgaaggaagcaaggacacggggcaggcacctggatgttgagagtggagatgtggcgctccaggttctgcttggcctccatctcctcgtccagctggtcttgcaggctgttccgctcctcctccagctggcgcagcttcgtagacacgttgagcttctgccgggtttcttcttgaagcagctcctgcaaaagggatgcaaagaggtcccagggacctgccccgaggaaggccaccccccaggtcccctggatgatgtggcaggacactcacctgggtgtcctggagctgggaactgagggacgccacgtccttggccagcttaatggccttcccctcggcctcgttaagcatccctgtgacgctctcaacttcattctaagggtgccaagagactggttagtcaaagcctctagaaggggatcctcgttgaaaggagccctttttactcaaaacacatgggctagtacttgaggtgttcactgattgagaaaatacccgtgaggtatgggactctgataaaaaaaaaaacacacacacacacaaaaaaaacagaatctgtggcttgaagggaactccgtcacctatgagttgggaccctggccctagactctgtggttctaagaacttatttgagccccaatggtattgactgggacctgatcccactaaatggatcctagatccctgccaaggttggtagagacaaagcagcaggtctgagagtccagacgaggtgctctggctggtccactctctaaggctggagaagggagaccaggatggtacttgaacgtcccagggatgctgtcccatcccttccttcctcactcctactctttgaccctgatggccaaagccagagacgcaggccctaaaggtaaaaacgtcctctctgtattctctggcttttactccctagtgtctctgcataagtccctttgaggctgttagcctacccctccatctcttccattgacaaggaggatatgaatgatcttgacactgcttatatgagggcggcaaaagccctgctctcaactgcatgtgagaaaaaaacatctcacttaattcttccctcgccccttggtccctggctgtggacatgttaaacatttgtgaaaactttggccacgtccccatgagtggcaaggcagggtaaatggctatgccaagtgaaagaagaccaaagacaaaaagaccatgtcattcagcagcttaaaacccctcaacagcttcacattgcccagagtaaggatcaacatacatgtaataggttctcaaaagccctacatcatctgggtacaagctccccctccaaccccactctgtactatctccccctacccccaaccccagctgggcactccagctctactggctgtatgtctctctcctaatttttctacttaccacagggcctttgcacacgctgttccctctgcctggtagacttatccatgctccttagggaagcctttcgtggctcctcctcccccaggttaggccccctggttatttacacttgggcatcatgtgccttccctttgctgcatcatttgacattcatttgtgtgattattcatgtctttcccttcccttcccttccccttactcggctggagtcctactggggcagcgacagtgtctcttcttccttgctgttggatctcaggattaagcacagtgcctggcatacagcaggtgctcaataaatacttatcaaattgaaaaaagaag

SEQ ID NO: 355075 - DNA, 3074 bp, Homo sapiens
ggccggggccgcaccgcccttcgcagccgcctctgccgccgccgccgcgttggcctcgccgcccctgctcggacaccatgccacaaggagagtgatctcttcccctgttttcacaatggaggactccggaaagactttcagctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcgcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcggggttggacacgagttgccgctggttgtccaaatcaacaaccaggtcgtccagctcctgctgaagcctgttcttggtcttttccagtttatcatacgcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgaatggcccctgtccctggccccacagactctgagaagcgaagaccatgtctcctcgttggagaaacccaatagcaggggaagctggggggtcaagcaccatcgcaccaacactccaccgcgatctgcctgcgggggatctcagcgcagagaagttgagaggacccatgaaggaagcaaggacacggggcaggcacctggatgttgagagtggagatgtggcgctccaggttctgcttggcctccatctcctcgtccagctggtcttgcaggctgttccgctcctcctccagctggcgcagcttcgtagacacgttgagcttctgccgggtttcttcttgaagcagctcctgcaaaagggatgcaaagaggtcccagggacctgccccgaggaaggccaccccccaggtcccctggatgatgtggcaggacactcacctgggtgtcctggagctgggaactgagggacgccacgtccttggccagcttaatggccttcccctcggcctcgttaagcatccctgtgacgctctcaacttcattctaagggtgccaagagactggttagtcaaagcctctagaaggggatcctcgttgaaaggagccctttttactcaaaacacatgggctagtacttgaggtgttcactgattgagaaaatacccgtgaggtatgggactctgataaaaaaaaaaacacacacacacacaaaaaaaacagaatctgtggcttgaagggaactccgtcacctatgagttgggaccctggccctagactctgtggttctaagaacttatttgagccccaatggtattgactgggacctgatcccactaaatggatcctagatccctgccaaggttggtagagacaaagcagcaggtctgagagtccagacgaggtgctctggctggtccactctctaaggctggagaagggagaccaggatggtacttgaacgtcccagggatgctgtcccatcccttccttcctcactcctactctttgaccctgatggccaaagccagagacgcaggccctaaaggtaaaaacgtcctctctgtattctctggcttttactccctagtgtctctgcataagtccctttgaggctgttagcctacccctccatctcttccattgacaaggaggatatgaatgatcttgacactgcttatatgagggcggcaaaagccctgctctcaactgcatgtgagaaaaaaacatctcacttaattcttccctcgccccttggtccctggctgtggacatgttaaacatttgtgaaaactttggccacgtccccatgagtggcaaggcagggtaaatggctatgccaagtgaaagaagaccaaagacaaaaagaccatgtcattcagcagcttaaaacccctcaacagcttcacattgcccagagtaaggatcaacatacatgtaataggttctcaaaagccctacatcatctgggtacaagctccccctccaaccccactctgtactatctccccctacccccaaccccagctgggcactccagctctactggctgtatgtctctctcctaatttttctacttaccacagggcctttgcacacgctgttccctctgcctggtagacttatccatgctccttagggaagcctttcgtggctcctcctcccccaggttaggccccctggttatttacacttgggcatcatgtgccttccctttgctgcatcatttgacattcatttgtgtgattattcatgtctttcccttcccttcccttccccttactcggctggagtcctactggggcagcgacagtgtctcttcttccttgctgttggatctcaggattaagcacagtgcctggcatacagcaggtgctcaataaatacttatcaaattgaaaaaagaag

SEQ ID NO: 355076 - DNA, 2984 bp, Homo sapiens
tttcagcaacaggttttcatgtccacaggttccgaggagatctctcaatcgccagtgcagtcggtggagcccactcgctgcgtcctcctggagcctgcgtttgaatttaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcgcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcggggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggttggacacgagttgccgctggttgtccaaatcaacaaccaggtcgtccagctcctgctgaagcctgttcttggtcttttccagtttatcatacgcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgaatggcccctgtccctggccccacagactctgagaagcgaagaccatgtctcctcgttggagaaacccaatagcaggggaagctggggggtcaagcaccatcgcaccaacactccaccgcgatctgcctgcgggggatctcagcgcagagaagttgagaggacccatgaaggaagcaaggacacggggcaggcacctggatgttgagagtggagatgtggcgctccaggttctgcttggcctccatctcctcgtccagctggtcttgcaggctgttccgctcctcctccagctggcgcagcttcgtagacacgttgagcttctgccgggtttcttcttgaagcagctcctgcaaaagggatgcaaagaggtcccagggacctgccccgaggaaggccaccccccaggtcccctggatgatgtggcaggacactcacctgggtgtcctggagctgggaactgagggacgccacgtccttggccagcttaatggccttcccctcggcctcgttaagcatccctgtgacgctctcaacttcattctaagggtgccaagagactggttagtcaaagcctctagaaggggatcctcgttgaaaggagccctttttactcaaaacacatgggctagtacttgaggtgttcactgattgagaaaatacccgtgaggtatgggactctgataaaaaaaaaaacacacacacacacaaaaaaaacagaatctgtggcttgaagggaactccgtcacctatgagttgggaccctggccctagactctgtggttctaagaacttatttgagccccaatggtattgactgggacctgatcccactaaatggatcctagatccctgccaaggttggtagagacaaagcagcaggtctgagagtccagacgaggtgctctggctggtccactctctaaggctggagaagggagaccaggatggtacttgaacgtcccagggatgctgtcccatcccttccttcctcactcctactctttgaccctgatggccaaagccagagacgcaggccctaaaggtaaaaacgtcctctctgtattctctggcttttactccctagtgtctctgcataagtccctttgaggctgttagcctacccctccatctcttccattgacaaggaggatatgaatgatcttgacactgcttatatgagggcggcaaaagccctgctctcaactgcatgtgagaaaaaaacatctcacttaattcttccctcgccccttggtccctggctgtggacatgttaaacatttgtgaaaactttggccacgtccccatgagtggcaaggcagggtaaatggctatgccaagtgaaagaagaccaaagacaaaaagaccatgtcattcagcagcttaaaacccctcaacagcttcacattgcccagagtaaggatcaacatacatgtaataggttctcaaaagccctacatcatctgggtacaagctccccctccaaccccactctgtactatctccccctacccccaaccccagctgggcactccagctctactggctgtatgtctctctcctaatttttctacttaccacagggcctttgcacacgctgttccctctgcctggtagacttatccatgctccttagggaagcctttcgtggctcctcctcccccaggttaggccccctggttatttacacttgggcatcatgtgccttccctttgctgcatcatttgacattcatttgtgtgattattcatgtctttcccttcccttcccttccccttactcggctggagtcctactggggcagcgacagtgtctcttcttccttgctgttggatctcaggattaagcacagtgcctggcatacagcaggtgctcaataaatacttatcaaattgaaaaaagaag

SEQ ID NO: 355077 - DNA, 2976 bp, Homo sapiens
ggccggggccgcaccgcccttcgcagccgcctctgccgccgccgccgcgttggcctcgccgcccctgctcggacaccatgccacaaggagagtgatctcttcccctgttttcacaatggaggactccggaaagactttcagctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcgcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcggggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggagagaaaattgagaccctgtgagaccctgctcctgactcttgatgttcacccttataactctctgggccccggtgctagccagtttgtcacagctgttatgtcagcttaatttggtttgctctgtctgaaggttggggaagcgcctggaatttgggaagccgccttcacacatgtcttcatcgccgctgccgtcagcccagggggtagtcaagatgttgctttaggaaaaccacggaagctgaaggtcttggtgttggtgcggaagtcgttaccttttgtcgtctttttacactaggtttttgttttaagttagtttgagaaataagagcagtcaccatagttagttagctttgcggcccaagccaatgaccgaggccatcacctgtgctctggggtttgtccctgggaaatgtcttttcatccttacctgccaccgtgtgcattgcaaagagggacaaaaggggctctctgggaagggctctaagttgtcggtgatgaggctaccgtgttgtttttgagatagagtcttgctctgtcacccaggctggagtgtggtggcgtgatctcagctcactgcaacctccgcctcctgggttcaaacggttcttgttcctgagtcttccaggtagctgggattacaggcacccaccaccacacctggctgaattttttgtatttttaatagagacggggttttgccatgttgcccagtgtggtcttgaactcctggcctcaagtgatcctcccatctcggcctcccagaatgctgggatttcaagcatgagccatcgttcccatgccccattgtgttgcactaacccaagcggaggtcctgattggtcttttttttttttttcttttttggagacagagtcttggctcttgccctgtcttgtccagggctggagtgtagtgggtggcaatttcgggctcaccgcagcctccgcctcctaggttcaagcgattctcttatctcagcttcccaagtagctgggactacgggagtgtgccactacacccactaattttggtatttttagtgagaaaccccatctctactaaaaatacaaaaaattagctgggtgcagtggtgcgtgcctataattccagctactccagatgttgaggcaggagagttgcttggacccgggaggtggagggtgcagtgagccgggatcgcgctactgtactccagcctgggcaacagagtgagactccgtctccaaaaaaaaaaaaaagggtgtcataaacctctgagactgtagcctgcttcttagcttctcattgagattcctagaggtgcgttcgagttttcagagtaattttccagaccaaccagcgtcagtgggaaatctgacctcttttggcaaactgcgatcattcattttcctgagtcccctggtggggtggggggaattctgcctcaggaccctgaggggtctttggggcaagatggccttggtaatgcagccactaagaacaggacttcattcaaaggcataatgaagtaaccagggtgaccatcaagtaaaattaaagcacaagatcattgtaggaggcttccttgtcaaagacgtgaacgtgggatttccaacgcaccacggtgtgtccactcatcactgcatgttaggaactgctgtctctttgggacacgagttaaaagaacacactaatttctggagtgtgcctgcagcttcacggccttcattttgttactaagttattttctggaagaacagcaaaaatttcaggttgaaaacagaactttccaagtgctactgaaattccgcagagaattacgctgcgatggtgggtttcttaccctagaaacatcctaacctgtatccacagaagatgtccttttatttttttaaaagatcaataaaatcaagagaaacgaaaaaaaaaaaag

SEQ ID NO: 355078 - DNA, 2490 bp, Homo sapiens
ggccggggccgcaccgcccttcgcagccgcctctgccgccgccgccgcgttggcctcgccgcccctgctcggacaccatgccacaaggagagtgatctcttcccctgttttcacaatggaggactccggaaagactttcagctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcgcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcggggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggagagaaaattgagaccctgtgagaccctgctcctgactcttgatgttcacccttataactctctgggccccggtgctagccagtttgtcacagctgttatgtcagcttaatttggtttgctctgtctgaaggttggggaagcgcctggaatttgggaagccgccttcacacatgtcttcatcgccgctgccgtcagcccagggggtagtcaagatgttgctttaggaaaaccacggaagctgaaggtcttggtgttggtgcggaagtcgttaccttttgtcgtctttttacactaggtttttgttttaagttagtttgagaaataagagcagtcaccatagttagttagctttgcggcccaagccaatgaccgaggccatcacctgtgctctggggtttgtccctgggaaatgtcttttcatccttacctgccaccgtgtgcattgcaaagagggacaaaaggggctctctgggaagggctctaagttgtcggtgatgaggctaccgtgttgtttttgagatagagtcttgctctgtcacccaggctggagtgtggtggcgtgatctcagctcactgcaacctccgcctcctgggttcaaacggttcttgttcctataattccagctactccagatgttgaggcaggagagttgcttggacccgggaggtggagggtgcagtgagccgggatcgcgctactgtactccagcctgggcaacagagtgagactccgtctccaaaaaaaaaaaaaagggtgtcataaacctctgagactgtagcctgcttcttagcttctcattgagattcctagaggtgcgttcgagttttcagagtaattttccagaccaaccagcgtcagtgggaaatctgacctcttttggcaaactgcgatcattcattttcctgagtcccctggtggggtggggggaattctgcctcaggaccctgaggggtctttggggcaagatggccttggtaatgcagccactaagaacaggacttcattcaaaggcataatgaagtaaccagggtgaccatcaagtaaaattaaagcacaagatcattgtaggaggcttccttgtcaaagacgtgaacgtgggatttccaacgcaccacggtgtgtccactcatcactgcatgttaggaactgctgtctctttgggacacgagttaaaagaacacactaatttctggagtgtgcctgcagcttcacggccttcattttgttactaagttattttctggaagaacagcaaaaatttcaggttgaaaacagaactttccaagtgctactgaaattccgcagagaattacgctgcgatggtgggtttcttaccctagaaacatcctaacctgtatccacagaagatgtccttttatttttttaaaagatcaataaaatcaagagaaacgaaaaaaaaaaaag

SEQ ID NO: 355079 - DNA, 2198 bp, Homo sapiens
tttattttgagacggagtcttgttcttgtccaggctggagtgcagtggcatgatctcgactcactgcaacctcagtcctccgggttcaagtgattcttctgcctcaccctcctgagtagctgggattacagacaccatgccacaaggagagtgatctcttcccctgttttcacaatggaggactccggaaagactttcagctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggagaagtttgaagtgcagcactctgaaggctaccggcagatctcagccttggaggatgacctcgcgcagaccaaagccattaaagaccaattgctttaggaaaaccacggaagctgaaggtcttggtgttggtgcggaagtcgttaccttttgtcgtctttttacactaggtttttgttttaagttagtttgagaaataagagcagtcaccatagttagttagctttgcggcccaagccaatgaccgaggccatcacctgtgctctggggtttgtccctgggaaatgtcttttcatccttacctgccaccgtgtgcattgcaaagagggacaaaaggggctctctgggaagggctctaagttgtcggtgatgaggctaccgtgttgtttttgagatagagtcttgctctgtcacccaggctggagtgtggtggcgtgatctcagctcactgcaacctccgcctcctgggttcaaacggttcttgttcctgagtcttccaggtagctgggattacaggcacccaccaccacacctggctgaattttttgtatttttaatagagacggggttttgccatgttgcccagtgtggtcttgaactcctggcctcaagtgatcctcccatctcggcctcccagaatgctgggatttcaagcatgagccatcgttcccatgccccattgtgttgcactaacccaagcggaggtcctgattggtcttttttttttttttcttttttggagacagagtcttggctcttgccctgtcttgtccagggctggagtgtagtgggtggcaatttcgggctcaccgcagcctccgcctcctaggttcaagcgattctcttatctcagcttcccaagtagctgggactacgggagtgtgccactacacccactaattttggtatttttagtgagaaaccccatctctactaaaaatacaaaaaattagctgggtgcagtggtgcgtgcctataattccagctactccagatgttgaggcaggagagttgcttggacccgggaggtggagggtgcagtgagccgggatcgcgctactgtactccagcctgggcaacagagtgagactccgtctccaaaaaaaaaaaaaagggtgtcataaacctctgagactgtagcctgcttcttagcttctcattgagattcctagaggtgcgttcgagttttcagagtaattttccagaccaaccagcgtcagtgggaaatctgacctcttttggcaaactgcgatcattcattttcctgagtcccctggtggggtggggggaattctgcctcaggaccctgaggggtctttggggcaagatggccttggtaatgcagccactaagaacaggacttcattcaaaggcataatgaagtaaccagggtgaccatcaagtaaaattaaagcacaagatcattgtaggaggcttccttgtcaaagacgtgaacgtgggatttccaacgcaccacggtgtgtccactcatcactgcatgttaggaactgctgtctctttgggacacgagttaaaagaacacactaatttctggagtgtgcctgcagcttcacggccttcattttgttactaagttattttctggaagaacagcaaaaatttcaggttgaaaacagaactttccaagtgctactgaaattccgcagagaattacgctgcgatggtgggtttcttaccctagaaacatcctaacctgtatccacagaagatgtccttttatttttttaaaagatcaataaaatcaagagaaacgaaaaaaaaaaaag

SEQ ID NO: 355080 - DNA, 900 bp, Homo sapiens
gtggggcagaagccgggacccttacgagaagctgctgttctgagcgcccgaccggcgtggcttgcgggctctagcgttaccattgcatccaggaccaggcaatggcacaccagaggagtagtcgatcgtcctgtccccctggttctatcaataatggaggactccggaaagactttcagctccgaggaggaagaagctaactattggaaagatctggcgatgacctacaaacagagggcagaaaatacgcaagaggaactccgagaattccaggagggaagccgagaatatgaagtgaattttttgtatttttaatagagacggggttttgccatgttgcccagtgtggtcttgaactcctggcctcaagtgatcctcccatctcggcctcccagaatgctgggatttcaagcatgagccatcgttcccatgccccattgtgttgcactaacccaagcggaggtcctgattggtcttttttttttttttcttttttggagacagagtcttggctcttgccctgtcttgtccagggctggagtgtagtgggtggcaatttcgggctcaccgcagcctccgcctcctaggttcaagcgattctcttatctcagcttcccaagtagctgggactacgggagtgtgccactacacccactaattttggtatttttagtgagaaccggggtttctctttgtgccagcgtcagagaagcacccgggacacaaagatgaaccacagagacctaaacacccagagatgcaggaaaatcagagcgtgaacaacagagcacggccaccgaatgggcataagaaggggtaaaagggcacaaagacacgaaatgtggaaggacacacagaggaacaccaacccaaaaagaaatacacaaaaaaaatcagaaa

SEQ ID NO: 355081 - DNA, 316 bp, Homo sapiens
ccccatgcccagctcagtggaagctgagaggacagacacagctgtgcaggccacgggctccgtgccgtccacgcccattgctcaccgaggacccagctcaagtttaaacacacctgggagcttcagacgtggtaaggggagtgggaattgcaggattttctcggttcacaaagtgtttctgggtaagaatctggggtgggtcctgggggtgtgatgatttgcatcaggctcagagcctgatttgctctcaggctttgagcagagagtagactgggatgttcttggggatgggcattgagatcagtgaggactgggt

SEQ ID NO: 355082 - DNA, 2538 bp, Homo sapiens
gtctgtaggttaagggagaagatggcggcgctaggggaacccgtgcggctggagagagatatttgtagagcaattgaattattggaaaaactacaaaggagtggagaagtaccaccacagaaacttcaggctttgcaaagagtccttcaaagtgaattctgcaatgctgtgagagaggtatatgaacatgtctatgagactgtggacatcagtagcagtcctgaagtgagagcgaacgctactgcaaaggctactgttgctgcatttgctgccagtgaaggacattctcatcctcgagttgttgagctaccaaaaacagaagagggccttggattcaatattatgggaggcaaagaacaaaactctccaatctatatatcccgaataattccaggtggaattgctgatagacatgggggcctcaaacgtggagatcaactcctctctgttaatggagtgagtgttgaaggagaacatcatgaaaaagctgtagaactgctgaaagccgcacaaggaaaggttaaattagtggtacgatacacacccaaagtcttagaagaaatggagtcgcgctttgaaaaaatgagatcagcaaaacgcaggcaacagacctaatacatttcaaaacttgatatttcattttgcgttttagctagagaagttttccttgtgacttactaatggctgcaatgccaatgattgtaagaaaacaaacaaatttatcatgaaattctccttgtcattttataaatgcctattttaacatcatttatggttccagagatgcatacacttttttctgacaagaaaaagtaaaaggtgatgagggcaattctgtcctactgtttttacaggcctttttcaaatgcagattttgtcataaagttgttatagattttttaaaatgcttttttaatattaaaatgtacttttacattcttaatctttttttagaaaggaaaagttttcttcatttagctgctgatttaaaagtaaagttctccaattctttttttttgcttactctattttttttaacctgtgaaatttctttacagttttccaagaaattaagcataacagtctcatctacggcagttcattacactgtcaatgttaacatcattgctgcattttgtactttgaacacacacataatatatataaccagtggtaaatcatgactcagtacagtgcaagttttttcacttttacttaaacataatatataatggatattcatttatactgatttatgaaagtaagtttttaaacactgaaacaatcattgctaaaatacatattcttaatatttgagcattgaggcaagaggatgtaattgatagcattacttattacatccctatttatgttcaaccgtacatcaaattataaatgcaaaacaggttcagatttcatcttttgtgatttcttttaaatactattcatttttatttaaatgcacagtatttcccctatattttagtccttccattcctagagacaaaccagttatttggtggtgggaagtagctgaagcaaagaaggaaaagtaatacctttaacctcactagcttcaagagtagacattcttactagctcaatttaaataattgattttaaataggaagaaaagaggatatatttaagatacatagaaattatgatgtgaagtattcatgagaatctgtagattccatcaaaataagtaggaactcatactaaaattgttggatttaaagaggcaacttttgtttatgattcaaatatgggaatttgagaaatatttcatttgtccactggatgtcactattttactaaaaggcagctattagtgtgggactgtgactgaggtcttaaagactgaaagagttggggttcattttctgttacaacttacaggaacatttgtactttaagaaaaatttaagtgacaaatgttagaagatgatggattgaaaaatataagtaatttggcatattgaccctatataaaaaagtgggcattttgtaacattccttcaggaagaatagaattgtatgcttttttctgcatgtttgtgatcactgtgagtctcagatgattattccagttttcaatgatttttcaaaataaaagtcaatcagcattgttatttatcattaaggtattgaacactggattgcatggttgaatgtgtctttaatccactacaaaatgtgcttgttattgataggatcatgttgttaaattgtaaattttcaaaattaattgatgttttaaaaatgttgagaccaaagtagtatagaagtatggacttaatttaattgtaaaattattagaggtatttgttgtagagctttatatattaaagagaggtattggtgcatataaaaacagtaatattattgttatgcttgtattcttgcatttcagggtaagtaaaccctgaagaaatcttattttagtatagctacagctgcagtagcttttaagtatgtatcaacatttcattataaattatagcttcctggttctgtgtctcagtgtttcagaac

SEQ ID NO: 355083 - DNA, 844 bp, Homo sapiens
  misc_feature (771)..(771): n is a, c, g, or t
  misc_feature (791)..(791): n is a, c, g, or t
  misc_feature (818)..(818): n is a, c, g, or t
gtctgtaggttaagggagaagatggcggcgctaggggaacccgtgcggctggagagagatatttgtagagcaattgaattattggaaaaactacaaaggagtggagaagtaccaccacagaaacttcaggctttgcaaagagtccttcaaagtgaattctgcaatgctgtgagagaggtatatgaacatgtctatgagactgtggacatcagtagcagtcctgaagtgagagcgaacgctactgcaaaggctactgttgctgcatttgctgccagtgaaggacattctcatcctcgagttgttgagctaccaaaaacagaagagggccttggattcaatattatgggaggcaaagaacaaaactctccaatctatatatcccgaataattccaggtggaattgctgatagacatgggggcctcaaacgtggagatcaactcctctctgttaatggagtgagtgttgaaggagaacatcatgaaaaagctgtagaactgctgaaagccgcacaaggaaaggttaaattagtggtacgatacacacccaaagtcttagaagaaatggagtcgcgctttgaaaaaatgagatcagcaaaacgcaggcaacagacctaatacatttcaaaacttgatatttcattttgcgttttagctagagaagttttccttgtgacttactaatggctgcaatgccaatgattgtaagaaaacaaacaaatttatcatgaaattctccttgtcattttataaatgcctattttaacaatccanttttaaggggttcccaagangaatgccattacaccttttttttcccngaacaaaggaaaaaaaagttaaaaaa

SEQ ID NO: 355084 - DNA, 6140 bp, Homo sapiens
aattggaagcaaatgacatcacagcaggtcagagaaaaagggttgagcggcaggcacccagagtagtaggtctttggcattaggagcttgagcccagacggccctagcagggaccccagcgcccgagagaccatgcagaggtcgcctctggaaaaggccagcgttgtctccaaactttttttcagctggaccagaccaattttgaggaaaggatacagacagcgcctggaattgtcagacatataccaaatcccttctgttgattctgctgacaatctatctgaaaaattggaaagagaatgggatagagagctggcttcaaagaaaaatcctaaactcattaatgcccttcggcgatgttttttctggagatttatgttctatggaatctttttatatttaggggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaagactttaaagctgtcaagccgtgttctagataaaataagtattggacaacttgttagtctcctttccaacaacctgaacaaatttgatgaaggacttgcattggcacatttcgtgtggatcgctcctttgcaagtggcactcctcatggggctaatctgggagttgttacaggcgtctgccttctgtggacttggtttcctgatagtccttgccctttttcaggctgggctagggagaatgatgatgaagtacagagatcagagagctgggaagatcagtgaaagacttgtgattacctcagaaatgattgaaaatatccaatctgttaaggcatactgctgggaagaagcaatggaaaaaatgattgaaaacttaagacaaacagaactgaaactgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggtatgactctcttggagcaataaacaaaatacaggatttcttacaaaagcaagaatataagacattggaatataacttaacgactacagaagtagtgatggagaatgtaacagccttctgggaggagggatttggggaattatttgagaaagcaaaacaaaacaataacaatagaaaaacttctaatggtgatgacagcctcttcttcagtaatttctcacttcttggtactcctgtcctgaaagatattaatttcaagatagaaagaggacagttgttggcggttgctggatccactggagcaggcaagacttcacttctaatgatgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggacatctccaagtttgcagagaaagacaatatagttcttggagaaggtggaatcacactgagtggaggtcaacgagcaagaatttctttagcaagagcagtatacaaagatgctgatttgtatttattagactctccttttggatacctagatgttttaacagaaaaagaaatatttgaaagctgtgtctgtaaactgatggctaacaaaactaggattttggtcacttctaaaatggaacatttaaagaaagctgacaaaatattaattttgaatgaaggtagcagctatttttatgggacattttcagaactccaaaatctacagccagactttagctcaaaactcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttgactgaactggatatatattcaagaaggttatctcaagaaactggcttggaaataagtgaagaaattaacgaagaagacttaaaggagtgcctttttgatgatatggagagcataccagcagtgactacatggaacacataccttcgatatattactgtccacaagagcttaatttttgtgctaatttggtgcttagtaatttttctggcagaggtggctgcttctttggttgtgctgtggctccttggaaacactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtgggattcttaatagattctccaaagatatagcaattttggatgaccttctgcctcttaccatatttgacttcatccagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaatatcatgagtacattgcagtgggctgtaaactccagcatagatgtggatagcttgatgcgatctgtgagccgagtctttaagttcattgacatgccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgccatattagagaacatttccttctcaataagtcctggccagagggtgggcctcttgggaagaactggatcagggaagagtactttgttatcagcttttttgagactactgaacactgaaggagaaatccagatcgatggtgtgtcttgggattcaataactttgcaacagtggaggaaagcctttggagtgataccacagaaagtatttattttttctggaacatttagaaaaaacttggatccctatgaacagtggagtgatcaagaaatatggaaagttgcagatgaggttgggctcagatctgtgatagaacagtttcctgggaagcttgactttgtccttgtggatgggggctgtgtcctaagccatggccacaagcagttgatgtgcttggctagatctgttctcagtaaggcgaagatcttgctgcttgatgaacccagtgctcatttggatccagtaacataccaaataattagaagaactctaaaacaagcatttgctgattgcacagtaattctctgtgaacacaggatagaagcaatgctggaatgccaacaatttttggtcatagaagagaacaaagtgcggcagtacgattccatccagaaactgctgaacgagaggagcctcttccggcaagccatcagcccctccgacagggtgaagctctttccccaccggaactcaagcaagtgcaagtctaagccccagattgctgctctgaaagaggagacagaagaagaggtgcaagatacaaggctttagagagcagcataaatgttgacatgggacatttgctcatggaattggagctcgtgggacagtcacctcatggaattggagctcgtggaacagttacctctgcctcagaaaacaaggatgaattaagtttttttttaaaaaagaaacatttggtaaggggaattgaggacactgatatgggtcttgataaatggcttcctggcaatagtcaaattgtgtgaaaggtacttcaaatccttgaagatttaccacttgtgttttgcaagccagattttcctgaaaacccttgccatgtgctagtaattggaaaggcagctctaaatgtcaatcagcctagttgatcagcttattgtctagtgaaactcgttaatttgtagtgttggagaagaactgaaatcatacttcttagggttatgattaagtaatgataactggaaacttcagcggtttatataagcttgtattcctttttctctcctctccccatgatgtttagaaacacaactatattgtttgctaagcattccaactatctcatttccaagcaagtattagaataccacaggaaccacaagactgcacatcaaaatatgccccattcaacatctagtgagcagtcaggaaagagaacttccagatcctggaaatcagggttagtattgtccaggtctaccaaaaatctcaatatttcagataatcacaatacatcccttacctgggaaagggctgttataatctttcacaggggacaggatggttcccttgatgaagaagttgatatgccttttcccaactccagaaagtgacaagctcacagacctttgaactagagtttagctggaaaagtatgttagtgcaaattgtcacaggacagcccttctttccacagaagctccaggtagagggtgtgtaagtagataggccatgggcactgtgggtagacacacatgaagtccaagcatttagatgtataggttgatggtggtatgttttcaggctagatgtatgtacttcatgctgtctacactaagagagaatgagagacacactgaagaagcaccaatcatgaattagttttatatgcttctgttttataattttgtgaagcaaaattttttctctaggaaatatttattttaataatgtttcaaacatatataacaatgctgtattttaaaagaatgattatgaattacatttgtataaaataatttttatatttgaaatattgactttttatggcactagtatttctatgaaatattatgttaaaactgggacaggggagaacctagggtgatattaaccaggggccatgaatcaccttttggtctggagggaagccttggggctgatgcagttgttgcccacagctgtatgattcccagccagcacagcctcttagatgcagttctgaagaagatggtaccaccagtctgactgtttccatcaagggtacactgccttctcaactccaaactgactcttaagaagactgcattatatttattactgtaagaaaatatcacttgtcaataaaatccatacatttgtgtgaaaaaaaaaag

SEQ ID NO: 355085 - DNA, 5995 bp, Homo sapiens
aattggaagcaaatgacatcacagcaggtcagagaaaaagggttgagcggcaggcacccagagtagtaggtctttggcattaggagcttgagcccagacggccctagcagggaccccagcgcccgagagaccatgcagaggtcgcctctggaaaaggccagcgttgtctccaaactttttttcagctggaccagaccaattttgaggaaaggatacagacagcgcctggaattgtcagacatataccaaatcccttctgttgattctgctgacaatctatctgaaaaattggaaagagaatgggatagagagctggcttcaaagaaaaatcctaaactcattaatgcccttcggcgatgttttttctggagatttatgttctatggaatctttttatatttaggggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaagactttaaagctgtcaagccgtgttctagataaaataagtattggacaacttgttagtctcctttccaacaacctgaacaaatttgatgaaggacttgcattggcacatttcgtgtggatcgctcctttgcaagtggcactcctcatggggctaatctgggagttgttacaggcgtctgccttctgtggacttggtttcctgatagtccttgccctttttcaggctgggctagggagaatgatgatgaagtacagagatcagagagctgggaagatcagtgaaagacttgtgattacctcagaaatgattgaaaatatccaatctgttaaggcatactgctgggaagaagcaatggaaaaaatgattgaaaacttaagacaaacagaactgaaactgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggtatgactctcttggagcaataaacaaaatacaggatttcttacaaaagcaagaatataagacattggaatataacttaacgactacagaagtagtgatggagaatgtaacagccttctgggaggagggatttggggaattatttgagaaagcaaaacaaaacaataacaatagaaaaacttctaatggtgatgacagcctcttcttcagtaatttctcacttcttggtactcctgtcctgaaagatattaatttcaagatagaaagaggacagttgttggcggttgctggatccactggagcaggcaagacttcacttctaatgatgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggacatctccaagtttgcagagaaagacaatatagttcttggagaaggtggaatcacactgagtggaggtcaacgagcaagaatttctttagcaagagcagtatacaaagatgctgatttgtatttattagactctccttttggatacctagatgttttaacagaaaaagaaatatttgaaagctgtgtctgtaaactgatggctaacaaaactaggattttggtcacttctaaaatggaacatttaaagaaagctgacaaaatattaattttgaatgaaggtagcagctatttttatgggacattttcagaactccaaaatctacagccagactttagctcaaaactcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttcgatatattactgtccacaagagcttaatttttgtgctaatttggtgcttagtaatttttctggcagaggtggctgcttctttggttgtgctgtggctccttggaaacactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtgggattcttaatagattctccaaagatatagcaattttggatgaccttctgcctcttaccatatttgacttcatccagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaatatcatgagtacattgcagtgggctgtaaactccagcatagatgtggatagcttgatgcgatctgtgagccgagtctttaagttcattgacatgccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgccatattagagaacatttccttctcaataagtcctggccagagggtgggcctcttgggaagaactggatcagggaagagtactttgttatcagcttttttgagactactgaacactgaaggagaaatccagatcgatggtgtgtcttgggattcaataactttgcaacagtggaggaaagcctttggagtgataccacagaaagtatttattttttctggaacatttagaaaaaacttggatccctatgaacagtggagtgatcaagaaatatggaaagttgcagatgaggttgggctcagatctgtgatagaacagtttcctgggaagcttgactttgtccttgtggatgggggctgtgtcctaagccatggccacaagcagttgatgtgcttggctagatctgttctcagtaaggcgaagatcttgctgcttgatgaacccagtgctcatttggatccagtaacataccaaataattagaagaactctaaaacaagcatttgctgattgcacagtaattctctgtgaacacaggatagaagcaatgctggaatgccaacaatttttggtcatagaagagaacaaagtgcggcagtacgattccatccagaaactgctgaacgagaggagcctcttccggcaagccatcagcccctccgacagggtgaagctctttccccaccggaactcaagcaagtgcaagtctaagccccagattgctgctctgaaagaggagacagaagaagaggtgcaagatacaaggctttagagagcagcataaatgttgacatgggacatttgctcatggaattggagctcgtgggacagtcacctcatggaattggagctcgtggaacagttacctctgcctcagaaaacaaggatgaattaagtttttttttaaaaaagaaacatttggtaaggggaattgaggacactgatatgggtcttgataaatggcttcctggcaatagtcaaattgtgtgaaaggtacttcaaatccttgaagatttaccacttgtgttttgcaagccagattttcctgaaaacccttgccatgtgctagtaattggaaaggcagctctaaatgtcaatcagcctagttgatcagcttattgtctagtgaaactcgttaatttgtagtgttggagaagaactgaaatcatacttcttagggttatgattaagtaatgataactggaaacttcagcggtttatataagcttgtattcctttttctctcctctccccatgatgtttagaaacacaactatattgtttgctaagcattccaactatctcatttccaagcaagtattagaataccacaggaaccacaagactgcacatcaaaatatgccccattcaacatctagtgagcagtcaggaaagagaacttccagatcctggaaatcagggttagtattgtccaggtctaccaaaaatctcaatatttcagataatcacaatacatcccttacctgggaaagggctgttataatctttcacaggggacaggatggttcccttgatgaagaagttgatatgccttttcccaactccagaaagtgacaagctcacagacctttgaactagagtttagctggaaaagtatgttagtgcaaattgtcacaggacagcccttctttccacagaagctccaggtagagggtgtgtaagtagataggccatgggcactgtgggtagacacacatgaagtccaagcatttagatgtataggttgatggtggtatgttttcaggctagatgtatgtacttcatgctgtctacactaagagagaatgagagacacactgaagaagcaccaatcatgaattagttttatatgcttctgttttataattttgtgaagcaaaattttttctctaggaaatatttattttaataatgtttcaaacatatataacaatgctgtattttaaaagaatgattatgaattacatttgtataaaataatttttatatttgaaatattgactttttatggcactagtatttctatgaaatattatgttaaaactgggacaggggagaacctagggtgatattaaccaggggccatgaatcaccttttggtctggagggaagccttggggctgatgcagttgttgcccacagctgtatgattcccagccagcacagcctcttagatgcagttctgaagaagatggtaccaccagtctgactgtttccatcaagggtacactgccttctcaactccaaactgactcttaagaagactgcattatatttattactgtaagaaaatatcacttgtcaataaaatccatacatttgtgtgaaaaaaaaaag

SEQ ID NO: 355086 - DNA, 419 bp, Homo sapiens
aaaatgttgttatttttatttcagatgcgatctgtgagccgagtctttaagttcattgacatgccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgccatattagagaacatttccttctcaataagtcctggccagagggtgagatttgaacactgcttgctttgttagactgtgttcagtaagtgaatcccagtagcctgaagcaatgtgttagcagaatctatttgtaacattattattgtacagtagaatcaatattaaacacacatgttttattatatgga

SEQ ID NO: 355087 - DNA, 467 bp, Homo sapiens
caccatctcattctgcattgttctgcgcatggcggtcactcggcaatttccctgggctgtacaaacatggtatgactctcttggagcaataaacaaaatacaggtaatgtaccataatgctgcattatatactatgatttaaataatcagtcaatagatcagttctaatgaactttgcaaaaatgtgcgaaaagatagaaaaagaaatttccttcactaggaagttataaaagttgccagctaatactaggaatgttcaccttaaacttttcctagcatttctctggacagtatgatggatgagagtggcattttatgccaaattaccttaaaatcccaataatactgatgtagctagcagctttgagaaattctaaagttttcaagtgataagactcaatttatacaaagctaattggataaacttgtatatgattaagaagcaaataaatacttattatgctttt

SEQ ID NO: 355088 - DNA, 5941 bp, Homo sapiens
aattggaagcaaatgacatcacagcaggtcagagaaaaagggttgagcggcaggcacccagagtagtaggtctttggcattaggagcttgagcccagacggccctagcagggaccccagcgcccgagagaccatgcagaggtcgcctctggaaaaggccagcgttgtctccaaactttttttcagctggaccagaccaattttgaggaaaggatacagacagcgcctggaattgtcagacatataccaaatcccttctgttgattctgctgacaatctatctgaaaaattggaaagagaatgggatagagagctggcttcaaagaaaaatcctaaactcattaatgcccttcggcgatgttttttctggagatttatgttctatggaatctttttatatttaggggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaagactttaaagctgtcaagccgtgttctagataaaataagtattggacaacttgttagtctcctttccaacaacctgaacaaatttgatgaaggacttgcattggcacatttcgtgtggatcgctcctttgcaagtggcactcctcatggggctaatctgggagttgttacaggcgtctgccttctgtggacttggtttcctgatagtccttgccctttttcaggctgggctagggagaatgatgatgaagtacagagatcagagagctgggaagatcagtgaaagacttgtgattacctcagaaatgattgaaaatatccaatctgttaaggcatactgctgggaagaagcaatggaaaaaatgattgaaaacttaagacaaacagaactgaaactgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggtatgactctcttggagcaataaacaaaatacaggatttcttacaaaagcaagaatataagacattggaatataacttaacgactacagaagtagtgatggagaatgtaacagccttctgggaggagggatttggggaattatttgagaaagcaaaacaaaacaataacaatagaaaaacttctaatggtgatgacagcctcttcttcagtaatttctcacttcttggtactcctgtcctgaaagatattaatttcaagatagaaagaggacagttgttggcggttgctggatccactggagcaggcaagacttcacttctaatgatgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggacatctccaagtttgcagagaaagacaatatagttcttggagaaggtggaatcacactgagtggaggtcaacgagcaagaatttctttagcaagagcagtatacaaagatgctgatttgtatttattagactctccttttggatacctagatgttttaacagaaaaagaaatatttgaaagctgtgtctgtaaactgatggctaacaaaactaggattttggtcacttctaaaatggaacatttaaagaaagctgacaaaatattaattttgaatgaaggtagcagctatttttatgggacattttcagaactccaaaatctacagccagactttagctcaaaactcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttcgatatattactgtccacaagagcttaatttttgtgctaatttggtgcttagtaatttttctggcagaggtggctgcttctttggttgtgctgtggctccttggaaacactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtgggattcttaatagattctccaaagatatagcaattttggatgaccttctgcctcttaccatatttgacttcatccagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaatatcatgagtacattgcagtgggctgtaaactccagcatagatgtggatagcttgatgcgatctgtgagccgagtctttaagttcattgacatgccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgccatattagagaacatttccttctcaataagtcctggccagagggtgggcctcttgggaagaactggatcagggaagagtactttgttatcagcttttttgagactactgaacactgaaggagaaatccagatcgatggtgtgtcttgggattcaataactttgcaacagtggaggaaagcctttggagtgataccacagaaagtatttattttttctggaacatttagaaaaaacttggatccctatgaacagtggagtgatcaagaaatatggaaagttgcagatgaggttgggctcagatctgtgatagaacagtttcctgggaagcttgactttgtccttgtggatgggggctgtgtcctaagccatggccacaagcagttgatgtgcttggctagatctgttctcagtaaggcgaagatcttgctgcttgatgaacccagtgctcatttggatccagtaacataccaaataattagaagaactctaaaacaagcatttgctgattgcacagtaattctctgtgaacacaggatagaagcaatgctggaatgccaacaatttttggtcatagaagagaacaaagtgcggcagtacgattccatccagaaactgctgaacgagaggagcctcttccggcaagccatcagcccctccgacagggtgaagctctttccccaccggaactcaagcaagtgcaagtctaagccccagattgctgctctgaaagaggagacagaagaagaggtgcaagatacaaggctttagagagcagcataaatgttgacatgggacatttgctcatggaattggagctcgtgggacagtcacctcatggaattggagctcgtggaacagttacctctgcctcagaaaacaaggatgaattaagtttttttttaaaaaagaaacatttggtaaggggaattgaggacactgatatgggtcttgataaatggcttcctggcaatagtcaaattgtgtgaaaggtacttcaaatccttgaagatttaccacttgtgttttgcaagccagattttcctgaaaacccttgccatgtgctagtaattggaaaggcagctctaaatgtcaatcagcctagttgatcagcttattgtctagtgaaactcgttaatttgtagtgttggagaagaactgaaatcatacttcttagggttatgattaagtaatgataactggaaacttcagcggtttatataagcttgtattcctttttctctcctctccccatgatgtttagaaacacaactatattgtttgctaagcattccaactatctcatttccaagcaagtattagaataccacaggaaccacaagactgcacatcaaaatatgccccattcaacatctagtgagcagtcaggaaagagaacttccagatcctggaaatcagggttagtattgtccaggtctaccaaaaatctcaatatttcagataatcacaatacatcccttacctgggaaagggctgttataatctttcacaggggacaggatggttcccttgatgaagaagttgatatgccttttcccaactccagaaagtgacaagctcacagacctttgaactagagtttagctggaaaagtatgttagtgcaaattgtcacaggacagcccttctttccacagaagctccaggtagagggtgtgtaagtagataggccatgggcactgtgggtagacacacatgaagtccaagcatttagatgtataggttgatggtggtatgttttcaggctagatgtatgtacttcatgctgtctacactaagagagaatgagagacacactgaagaagcaccaatcatgaattagttttatatgcttctgttttataattttgtgaagcaaaattttttctctaggaaatatttattttaataatgtttcaaacatatataacaatgctgtattttaaaagaatgattatgaattacatttgtataaaataatttttatatttgaaatattgactttttatggcactagtatttctatgaaatattatgttcttttggtctggagggaagccttggggctgatgcagttgttgcccacagctgtatgattcccagccagcacagcctcttagatgcagttctgaagaagatggtaccaccagtctgactgtttccatcaagggtacactgccttctcaactccaaactgactcttaagaagactgcattatatttattactgtaagaaaatatcacttgtcaataaaatccatacatttgtgtgaaaaaaaaaag

SEQ ID NO: 355089 - DNA, 4006 bp, Homo sapiens
aattggaagcaaatgacatcacagcaggtcagagaaaaagggttgagcggcaggcacccagagtagtaggtctttggcattaggagcttgagcccagacggccctagcagggaccccagcgcccgagagaccatgcagaggtcgcctctggaaaaggccagcgttgtctccaaactttttttcagctggaccagaccaattttgaggaaaggatacagacagcgcctggaattgtcagacatataccaaatcccttctgttgattctgctgacaatctatctgaaaaattggaaagagaatgggatagagagctggcttcaaagaaaaatcctaaactcattaatgcccttcggcgatgttttttctggagatttatgttctatggaatctttttatatttaggggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaagactttaaagctgtcaagccgtgttctagataaaataagtattggacaacttgttagtctcctttccaacaacctgaacaaatttgatgaaggacttgcattggcacatttcgtgtggatcgctcctttgcaagtggcactcctcatggggctaatctgggagttgttacaggcgtctgccttctgtggacttggtttcctgatagtccttgccctttttcaggctgggctagggagaatgatgatgaagtacagagatcagagagctgggaagatcagtgaaagacttgtgattacctcagaaatgattgaaaatatccaatctgttaaggcatactgctgggaagaagcaatggaaaaaatgattgaaaacttaagacaaacagaactgaaactgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggtatgactctcttggagcaataaacaaaatacaggatttcttacaaaagcaagaatataagacattggaatataacttaacgactacagaagtagtgatggagaatgtaacagccttctgggaggagggatttggggaattatttgagaaagcaaaacaaaacaataacaatagaaaaacttctaatggtgatgacagcctcttcttcagtaatttctcacttcttggtactcctgtcctgaaagatattaatttcaagatagaaagaggacagttgttggcggttgctggatccactggagcaggcaagacttcacttctaatgatgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggacatctccaagtttgcagagaaagacaatatagttcttggagaaggtggaatcacactgagtggaggtcaacgagcaagaatttctttagcaagagcagtatacaaagatgctgatttgtatttattagactctccttttggatacctagatgttttaacagaaaaagaaatatttgaaagctgtgtctgtaaactgatggctaacaaaactaggattttggtcacttctaaaatggaacatttaaagaaagctgacaaaatattaattttgaatgaaggtagcagctatttttatgggacattttcagaactccaaaatctacagccagactttagctcaaaactcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttcgatatattactgtccacaagagcttaatttttgtgctaatttggtgcttagtaatttttctggcagaggtggctgcttctttggttgtgctgtggctccttggaaacactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtgggattcttaatagattctccaaagatatagcaattttggatgaccttctgcctcttaccatatttgacttcatccagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaatatcatgagtacattgcagtgggctgtaaactccagcatagatgtggatagcttgatgcgatctgtgagccgagtctttaagttcattgacatgccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgccatattagagaacatttccttctcaataagtcctggccagagggtgagatttgaacactgcttgctttgttagactgtgttcagtaagtgaatcccagtagcctgaagcaatgtgttagcagaatctatttgtaacattattattgtacagtagaatcaatattaaacacacatgttttattatatggagtcattatttttaatatgaaatttaatttgcagagtcctgaacctatataatgggtttattttaaatgtgattgtacttgcagaatatctaattaattgctaggttaataactaaagaagccattaaataaatcaaaattgtaacatgttttagat

SEQ ID NO: 355090 - DNA, 1399 bp, Homo sapiens
ttacgggcatatgtcgaccacggcgtcgagaatggctgagcaggacagtgggagaccagaccctaccccgcaactccagtaagcagggcactgcccagggagactgccttcagaaacctgagcttcagcggccaacaccccccatcccctgcgcatccttgtctcatttggggactggtggagctggctgagaggttggggtagtttcctggttacaggggtccacaagaccctctctcatcccggtataggggcctctctcctctcatcgggcctgataagggattggccaaggctgtgtgcatcctgcagagggaaggaagtcagctgggccacccgccatccaccttggcaagagctgggcccactctggcaggccagggtatcatctgcgtgctgctgccgggccaggaagggtgggtgggtggccagcaggctggcagctccagaccccagagggccagaagaactcaccccagtgccctctggatgcaggtgttggggaacactgaggacaatcccccatctcccctcacccttgagcaggccctccctgcactctctgccacatgtccctcctggtctgatcacggctgtgctcactgatgtggctgctttctgtctctgcccctgtgcccttggaggcaggcagtgaggtgctcctttcccaggcccccaccccttctcccccttcagccacttcccagcgagttggaaatgtgccttgcacccccagccgagtgaagcccagaacgcatctatatgcatcgatgtaacaagctcggatcagggacctaattggtttcccagtagtgggtaatttctcgttgcaaatattaatccgttgtttttctggcgcccagcccggcccgccgcagtactgtactcgaggtacgttcctatgcaaccgagagccccggcaaatacttcatgagcttagcagcctgggctcgagcagctatgcaaacgcgcttttcatttggagcacggggctgatgtgaagataagaattgtttctcctggagaaagatccatcatttctccagcttccaagcccccggcacctctgctcagctcccagatgtgacgagcacctcccgccagggggagtcaggggttgatcaaaccagctcttgtgacccaaaccagtgccgctgcattaaagggaggcccagctactccttcccagctgagatgtgggtacaggtcagatttgtcagggagatggcactaacacgacacaagctcactcccagaaccgcagctgatgtttataataatcgtatgtactgtgcaatttaggaggggaaaaaaaggctgtacaagctttaactctaaaataaatttctatttttttcctcttgcaaaattaataaaagatgttattaagaataaaaac

SEQ ID NO: 355091 - DNA, 465 bp, Homo sapiens
taacctcgtacctgggttgacgtgagcttccggttcgagctcccggaaccgccgcctctagggatggacggtcagactctgcgaaaggccgagagaagctggtcctgctcacgagagaaaaaggaggtaaatgtgtccctggcgagggctgatgggaggcaactctatttgaaaggacctgagggagcagggtggcgaataagtgtccctaaatatactcttttctcttggggtcccaagcttgaatcctggagcaaatgatagtgagcaactagacttaccaacccagtgtcacttgtaataatcacttgtaataatcacttgtaataatcatctctgagtgtatcagttaactttgtctgtgtaacaaatcatcccagattttagtggcttaaaacaacaaccatatatttagttctggatttggtgggttagcagtttgggcttatctgggcagttctgctg

SEQ ID NO: 355092 - DNA, 6794 bp, Homo sapiens
taacctcgtacctgggttgacgtgagcttccggttcgagctcccggaaccgccgcctctagggatggacggtcagactctgcgaaaggccgagagaagctggtcctgctcacgagagaaaaaggagggttacgctaaggacatggtgacagactttgatgagaaacatgatgagtatttaatattgcttcagcagaggaaccggatattaaagcatttgaaaagcaaggaccccgtgcaattgaggctggagcacttggagcaaggtttctctgtctatgtcaacggtgccaattcggagctgaaatcatcaccgcggaaagctattcactctgacttctccagaagtgcctcccacacggaggggacacacgattatggacgaagaactctgtttcgagaagctgaagaagccttaagacgcagttcacggacagcccccagtaaagtccagcgccgaggatggcaccagaaatctgtgcagatcagaacagaagctggcccacggctccacatcgaacctcctgtggactattctgatgattttgagctgtgtggggatgtgactctccaggcaaacaacacttctgaggatcgtccgcaggataccaaatctcccaccagtaccaagccctgtggttttaacttctcccttctgaatgcatgtggacattctgacccttcaagcagcgtggacaaagaaaggatcctcttaactattcaggatgtgatggagctgagaagaagcctggaacttagtgtaaatctacaaaggaaacaaaaggattgttccagcgatgagtatgactctattgaggaagacatactctctgagcctgagccagaggacccggcactggtgggccatcccagacatgaccgccctccttccagtggcgactggactcagaaagatgttcacggggaacaggagacagaaggacgctcttctccaggcccagacaccctcgtggtgctggaatttaacccagcttccaaaagtcataaaagggaaaggaatttgtctgcaaagcggaaggacaatgctgaggttttcgttcccaccaaacctgagccaaacctgactccccaagctcctgctgtattcccagaccaggagaggatgtgctccagacctggaagccggcgagagagacccctgtctgcaacccgcaaaactctttgcgaggctgagtacccagaggaagatgcctctgctgtgctccaagccatccaggtggagaacgcagccctgcagagggcgctcctcagcagaaaggccgagcagccagccagcccactgcaggatgcagaaggaccaccagcaaaaccatggaccagtctgctggaggagaaggaagagacccttgagctgcttcccatcaccacggcgactactactcaggagccggccggggcagcaggaggagccagggccatcaaccaggccatggacagaattgggcttctgggaagcagacaacagcagaagcttctgaaagtcctccaggccgtcgaaagtgactctgcccatctcggcagggtggtttcaccaaccaaggagcaagtatcagacacagaggacaaacagagaatgagggcagacgagatcaaagatgccatctacgtgaccatggagatcctgtccaactggggcaactcgtggtgggtgggtctcacagaagtcgagttctttgacttgaatgacacaaagctttatgtgtcgccccacgatgtggatatccggaacacagccacgcctggggagctgggccgcctcgtcaacaggaacttagctggcaagaaagactcctccccgtggacctgccccttccacccaccactccagctgttttttgttattcgaaacacaagacagctgggggacttccatctggccaagatcaaggttcggaattactggacagctgatggcgatcttgacattggtgccaagaacgtgaagctttacgtcaacagaaacctcatcttcaatggcaagttagacaaaggagatagggaggccccagctgaccacagcatcctggttgaccagaagaacgagaagagcgagcaactagaggaggccatgaacgctcactcggaagaaagcaaaggcacccatgagatggctggtgccagcggggacaaggagcttggtctcggttgctcaccgccagctgaaacattagcggatgcaaagctttcttcacaaggaaatgtgtctggcaaaagaaagaattctactaattgcaggaaagacagtttgtcccagttagaggaatatttgagactgtcggcagtccccacttcgatgggtgacatgcccagtgctcctgccacttccccacctgtgaagtgccctcctgtccatgaggagccctctctcatccaacaactggaaaacctcatgggcagaaaaatctgtgagccacccgggaaaaccccatcctggttacaaccttctcccaccggcaaggacaggaagcagggaggcaggaagccaaaacccctctggcttagtcccgagaagcccctggcctggaagggcaggctcccatcagacgatgtcatcggtgagggtcctggagagaccgaggccagggataaaggcctacggcatgagccagggtgggggaccagccggagtgtcaacaccaaggagagaccccagagggcaaccaccaaagtccacagtgatgactcagacatctttaaccagccccccaacagagagcgccctgctagtgggaggaggggctcaaggaaggatgctggcagcagtagtcatggggacgaccagccagccagcagagaagacacctggtcttccaggacgccgtcacggtcaaggtggcgcagtgagcaggagcacacacttcacgagtcatggagctccctcagtgccttcgaccgctcccaccggggacgcatctccaacacggagctcccgggggacatcctggatgagctcctgcagcaaaagagcagccggcacagcgacttgcccccctccaagaagggggagcagccagggctgtcgagagggcaggatggctactctggagagacagacgctgggggtgactttaaaatccccgtcttgccttatggacagcgcttggtcattgacatcaagtctacctggggggacagacactatgtcggcctcaacggaatagaaatattcagttccaagggtgaaccggtgcagatttcaaacataaaagcagaccctcccgatatcaatattttaccagcctatgggaaagacccccgcgtggtcaccaacctcatcgacggggtgaacaggacccaggatgacatgcatgtctggctggcccccttcacgcggggcagatcccactccatcaccattgacttcacgcacccttgccacgttgccctgatcagaatttggaactacaataaatctcggatacattccttccgaggcgtgaaggacatcacaatgctgttagacacccagtgcatctttgaaggagaaatcgccaaggcctctggaaccctggcgggagccccagagcactttggagacacgatcttattcacaaccgatgatgacattctcgaggccatattctattctgatgagatgtttgacctggatgtggggagcctggacagcctgcaggatgaagaggcaatgaggaggcccagcacggccgacggcgagggggatgagcggcccttcacccaggctggcttgggggctgatgaacggatcccggagctagagctcccatccagttcccctgtcccccaagtcaccacgccagagccaggcatctaccacggaatctgccttcagctgaatttcactgcctcctggggagacttgcactacctggggctcactggcctggaagtggtgggcaaggagggccaggcgctgcccatccacctgcaccagatctctgcttcccccagagacttaaatgagctccccgagtactctgacgactcccggaccctggacaagttaattgatggcaccaacatcaccatggaggatgagcatatgtggctgatccccttctcgccggggctggaccatgtggtcacgatccgcctggacagggccgaaagcatcgcaggcctgcgcttctggaactacaataaatctcccgaggacacctatcgcggggccaagattgtccacgtctccctggatggcctgtgcgtctccccgccagagggctttctcatccggaaggggccaggcaactgccactttgattttgctcaagaaatcctcttcgtggactacctacgggctcagctgctgccccagccggccaggaggctggacatgagaagcctggagtgtgcaagcatggactacgaggcaccgctgatgccctgtggcttcattttccagtttcagcttctcaccagctggggcgacccctactacatcggcctcaccggcctggagctgtatgacgagcgaggagaaaaaatccccttgtcggaaaacaatattgcggccttccccgacagcgtgaactccctggagggtgtgggcggggacgtccgcaccccagacaagctcatcgaccaagtgaacgacaccagtgatggccggcacatgtggctggctcccatcctgccgggcctggtgaaccgggtttatgtgattttcgatctgcctaccaccgtgtcaatgatcaaactgtggaattatgcgaaaacaccccatcgaggggtgaaggagtttggcctcctggtggacgacctgcttgtgtacaatgggatcctggccatggtgagccacctggtggggggcatcctgcccacatgtgagcccaccgtgccctaccacaccatcctcttcaccgaggacagggacatccgccaccaggagaaacacaccaccatcagtaatcaggccgaggatcaagatgtccagatgatgaatgaaaaccaaatcattaccaacgcgaaacggaagcagagcgttgttgacccagccttacgtcccaaaacctgcatcagcgagaaggagacgagacgacggcgctgctgactggtgaaggagggagagctggtcctcccactatggtgggctccgtcagcagccccactcagtgcctgcgtccctcaccctcagtcccaggagctggaagcgaaccacagtgttgaggggagcccgctgggaagaggggactcgggaggacagccctggatactaccagagtgacagatggctgtggctgcagggcaaagagatcccctgcagttctgggttggccacagggagcccaggacacccgccttcatgcctctgctgtgagacccagcaaagcagggcccatgaccactagggcctgggctgaccctgactcagaacaggacaatgacggggtggggaggcatcccatccagcctcagagggcccagagaatggctgagcaggacagtgggagaccagaccctaccccgcaactccagtaagcagggcactgcccagggagactgccttcagaaacctgagcttcagcggccaacaccccccatcccctgcgcatccttgtctcatttggggactggtggagctggctgagaggttggggtagtttcctggttacaggggtccacaagaccctctctcatcccggtataggggcctctctcctctcatcgggcctgataagggattggccaaggctgtgtgcatcctgcagagggaaggaagtcagctgggccacccgccatccaccttggcaagagctgggcccactctggcaggccagggtatcatctgcgtgctgctgccgggccaggaagggtgggtgggtggccagcaggctggcagctccagaccccagagggccagaagaactcaccccagtgccctctggatgcaggtgttggggaacactgaggacaatcccccatctcccctcacccttgagcaggccctccctgcactctctgccacatgtccctcctggtctgatcacggctgtgctcactgatgtggctgctttctgtctctgcccctgtgcccttggaggcaggcagtgaggtgctcctttcccaggcccccaccccttctcccccttcagccacttcccagcgagttggaaatgtgccttgcacccccagccgagtgaagcccagaacgcatctatatgcatcgatgtaacaagctcggatcagggacctaattggtttcccagtagtgggtaatttctcgttgcaaatattaatccgttgtttttctggcgcccagcccggcccgccgcagtactgtactcgaggtacgttcctatgcaaccgagagccccggcaaatacttcatgagcttagcagcctgggctcgagcagctatgcaaacgcgcttttcatttggagcacggggctgatgtgaagataagaattgtttctcctggagaaagatccatcatttctccagcttccaagcccccggcacctctgctcagctcccagatgtgacgagcacctcccgccagggggagtcaggggttgatcaaaccagctcttgtgacccaaaccagtgccgctgcattaaagggaggcccagctactccttcccagctgagatgtgggtacaggtcagatttgtcagggagatggcactaacacgacacaagctcactcccagaaccgcagctgatgtttataataatcgtatgtactgtgcaatttaggaggggaaaaaaaggctgtacaagctttaactctaaaataaatttctatttttttcctcttgcaaaattaataaaagatgttattaagaataaaaac

SEQ ID NO: 355093 - DNA, 6717 bp, Homo sapiens
taacctcgtacctgggttgacgtgagcttccggttcgagctcccggaaccgccgcctctagggatggacggtcagactctgcgaaaggccgagagaagctggtcctgctcacgagagaaaaaggaggatattaaagcatttgaaaagcaaggaccccgtgcaattgaggctggagcacttggagcaaggtttctctgtctatgtcaacggtgccaattcggagctgaaatcatcaccgcggaaagctattcactctgacttctccagaagtgcctcccacacggaggggacacacgattatggacgaagaactctgtttcgagaagctgaagaagccttaagacgcagttcacggacagcccccagtaaagtccagcgccgaggatggcaccagaaatctgtgcagatcagaacagaagctggcccacggctccacatcgaacctcctgtggactattctgatgattttgagctgtgtggggatgtgactctccaggcaaacaacacttctgaggatcgtccgcaggataccaaatctcccaccagtaccaagccctgtggttttaacttctcccttctgaatgcatgtggacattctgacccttcaagcagcgtggacaaagaaaggatcctcttaactattcaggatgtgatggagctgagaagaagcctggaacttagtgtaaatctacaaaggaaacaaaaggattgttccagcgatgagtatgactctattgaggaagacatactctctgagcctgagccagaggacccggcactggtgggccatcccagacatgaccgccctccttccagtggcgactggactcagaaagatgttcacggggaacaggagacagaaggacgctcttctccaggcccagacaccctcgtggtgctggaatttaacccagcttccaaaagtcataaaagggaaaggaatttgtctgcaaagcggaaggacaatgctgaggttttcgttcccaccaaacctgagccaaacctgactccccaagctcctgctgtattcccagaccaggagaggatgtgctccagacctggaagccggcgagagagacccctgtctgcaacccgcaaaactctttgcgaggctgagtacccagaggaagatgcctctgctgtgctccaagccatccaggtggagaacgcagccctgcagagggcgctcctcagcagaaaggccgagcagccagccagcccactgcaggatgcagaaggaccaccagcaaaaccatggaccagtctgctggaggagaaggaagagacccttgagctgcttcccatcaccacggcgactactactcaggagccggccggggcagcaggaggagccagggccatcaaccaggccatggacagaattgggcttctgggaagcagacaacagcagaagcttctgaaagtcctccaggccgtcgaaagtgactctgcccatctcggcagggtggtttcaccaaccaaggagcaagtatcagacacagaggacaaacagagaatgagggcagacgagatcaaagatgccatctacgtgaccatggagatcctgtccaactggggcaactcgtggtgggtgggtctcacagaagtcgagttctttgacttgaatgacacaaagctttatgtgtcgccccacgatgtggatatccggaacacagccacgcctggggagctgggccgcctcgtcaacaggaacttagctggcaagaaagactcctccccgtggacctgccccttccacccaccactccagctgttttttgttattcgaaacacaagacagctgggggacttccatctggccaagatcaaggttcggaattactggacagctgatggcgatcttgacattggtgccaagaacgtgaagctttacgtcaacagaaacctcatcttcaatggcaagttagacaaaggagatagggaggccccagctgaccacagcatcctggttgaccagaagaacgagaagagcgagcaactagaggaggccatgaacgctcactcggaagaaagcaaaggcacccatgagatggctggtgccagcggggacaaggagcttggtctcggttgctcaccgccagctgaaacattagcggatgcaaagctttcttcacaaggaaatgtgtctggcaaaagaaagaattctactaattgcaggaaagacagtttgtcccagttagaggaatatttgagactgtcggcagtccccacttcgatgggtgacatgcccagtgctcctgccacttccccacctgtgaagtgccctcctgtccatgaggagccctctctcatccaacaactggaaaacctcatgggcagaaaaatctgtgagccacccgggaaaaccccatcctggttacaaccttctcccaccggcaaggacaggaagcagggaggcaggaagccaaaacccctctggcttagtcccgagaagcccctggcctggaagggcaggctcccatcagacgatgtcatcggtgagggtcctggagagaccgaggccagggataaaggcctacggcatgagccagggtgggggaccagccggagtgtcaacaccaaggagagaccccagagggcaaccaccaaagtccacagtgatgactcagacatctttaaccagccccccaacagagagcgccctgctagtgggaggaggggctcaaggaaggatgctggcagcagtagtcatggggacgaccagccagccagcagagaagacacctggtcttccaggacgccgtcacggtcaaggtggcgcagtgagcaggagcacacacttcacgagtcatggagctccctcagtgccttcgaccgctcccaccggggacgcatctccaacacggagctcccgggggacatcctggatgagctcctgcagcaaaagagcagccggcacagcgacttgcccccctccaagaagggggagcagccagggctgtcgagagggcaggatggctactctggagagacagacgctgggggtgactttaaaatccccgtcttgccttatggacagcgcttggtcattgacatcaagtctacctggggggacagacactatgtcggcctcaacggaatagaaatattcagttccaagggtgaaccggtgcagatttcaaacataaaagcagaccctcccgatatcaatattttaccagcctatgggaaagacccccgcgtggtcaccaacctcatcgacggggtgaacaggacccaggatgacatgcatgtctggctggcccccttcacgcggggcagatcccactccatcaccattgacttcacgcacccttgccacgttgccctgatcagaatttggaactacaataaatctcggatacattccttccgaggcgtgaaggacatcacaatgctgttagacacccagtgcatctttgaaggagaaatcgccaaggcctctggaaccctggcgggagccccagagcactttggagacacgatcttattcacaaccgatgatgacattctcgaggccatattctattctgatgagatgtttgacctggatgtggggagcctggacagcctgcaggatgaagaggcaatgaggaggcccagcacggccgacggcgagggggatgagcggcccttcacccaggctggcttgggggctgatgaacggatcccggagctagagctcccatccagttcccctgtcccccaagtcaccacgccagagccaggcatctaccacggaatctgccttcagctgaatttcactgcctcctggggagacttgcactacctggggctcactggcctggaagtggtgggcaaggagggccaggcgctgcccatccacctgcaccagatctctgcttcccccagagacttaaatgagctccccgagtactctgacgactcccggaccctggacaagttaattgatggcaccaacatcaccatggaggatgagcatatgtggctgatccccttctcgccggggctggaccatgtggtcacgatccgcctggacagggccgaaagcatcgcaggcctgcgcttctggaactacaataaatctcccgaggacacctatcgcggggccaagattgtccacgtctccctggatggcctgtgcgtctccccgccagagggctttctcatccggaaggggccaggcaactgccactttgattttgctcaagaaatcctcttcgtggactacctacgggctcagctgctgccccagccggccaggaggctggacatgagaagcctggagtgtgcaagcatggactacgaggcaccgctgatgccctgtggcttcattttccagtttcagcttctcaccagctggggcgacccctactacatcggcctcaccggcctggagctgtatgacgagcgaggagaaaaaatccccttgtcggaaaacaatattgcggccttccccgacagcgtgaactccctggagggtgtgggcggggacgtccgcaccccagacaagctcatcgaccaagtgaacgacaccagtgatggccggcacatgtggctggctcccatcctgccgggcctggtgaaccgggtttatgtgattttcgatctgcctaccaccgtgtcaatgatcaaactgtggaattatgcgaaaacaccccatcgaggggtgaaggagtttggcctcctggtggacgacctgcttgtgtacaatgggatcctggccatggtgagccacctggtggggggcatcctgcccacatgtgagcccaccgtgccctaccacaccatcctcttcaccgaggacagggacatccgccaccaggagaaacacaccaccatcagtaatcaggccgaggatcaagatgtccagatgatgaatgaaaaccaaatcattaccaacgcgaaacggaagcagagcgttgttgacccagccttacgtcccaaaacctgcatcagcgagaaggagacgagacgacggcgctgctgactggtgaaggagggagagctggtcctcccactatggtgggctccgtcagcagccccactcagtgcctgcgtccctcaccctcagtcccaggagctggaagcgaaccacagtgttgaggggagcccgctgggaagaggggactcgggaggacagccctggatactaccagagtgacagatggctgtggctgcagggcaaagagatcccctgcagttctgggttggccacagggagcccaggacacccgccttcatgcctctgctgtgagacccagcaaagcagggcccatgaccactagggcctgggctgaccctgactcagaacaggacaatgacggggtggggaggcatcccatccagcctcagagggcccagagaatggctgagcaggacagtgggagaccagaccctaccccgcaactccagtaagcagggcactgcccagggagactgccttcagaaacctgagcttcagcggccaacaccccccatcccctgcgcatccttgtctcatttggggactggtggagctggctgagaggttggggtagtttcctggttacaggggtccacaagaccctctctcatcccggtataggggcctctctcctctcatcgggcctgataagggattggccaaggctgtgtgcatcctgcagagggaaggaagtcagctgggccacccgccatccaccttggcaagagctgggcccactctggcaggccagggtatcatctgcgtgctgctgccgggccaggaagggtgggtgggtggccagcaggctggcagctccagaccccagagggccagaagaactcaccccagtgccctctggatgcaggtgttggggaacactgaggacaatcccccatctcccctcacccttgagcaggccctccctgcactctctgccacatgtccctcctggtctgatcacggctgtgctcactgatgtggctgctttctgtctctgcccctgtgcccttggaggcaggcagtgaggtgctcctttcccaggcccccaccccttctcccccttcagccacttcccagcgagttggaaatgtgccttgcacccccagccgagtgaagcccagaacgcatctatatgcatcgatgtaacaagctcggatcagggacctaattggtttcccagtagtgggtaatttctcgttgcaaatattaatccgttgtttttctggcgcccagcccggcccgccgcagtactgtactcgaggtacgttcctatgcaaccgagagccccggcaaatacttcatgagcttagcagcctgggctcgagcagctatgcaaacgcgcttttcatttggagcacggggctgatgtgaagataagaattgtttctcctggagaaagatccatcatttctccagcttccaagcccccggcacctctgctcagctcccagatgtgacgagcacctcccgccagggggagtcaggggttgatcaaaccagctcttgtgacccaaaccagtgccgctgcattaaagggaggcccagctactccttcccagctgagatgtgggtacaggtcagatttgtcagggagatggcactaacacgacacaagctcactcccagaaccgcagctgatgtttataataatcgtatgtactgtgcaatttaggaggggaaaaaaaggctgtacaagctttaactctaaaataaatttctatttttttcctcttgcaaaattaataaaagatgttattaagaataaaaac

SEQ ID NO: 355094 - DNA, 5751 bp, Homo sapiens
agcggaagcactgcctttcccctccccagagtcatcccacttagtcaattaagtcagtggaagctcattcttagaggaagttccagggcaggcatcttttctgtttgccatcgagaagctggctggcatggtttggaaggaaagcatcccgcctcgacctggaagccggcgagagagacccctgtctgcaacccgcaaaactctttgcgaggctgagtacccagaggaagatgcctctgctgtgctccaagccatccaggtggagaacgcagccctgcagagggcgctcctcagcagaaaggccgagcagccagccagcccactgcagctgcttcccatcaccacggcgactactactcaggagccggccggggcagcaggaggagccagggccatcaaccaggccatggacagaattgggcttctgggaagcagacaacagcagaagcttctgaaagtcctccaggccgtcgaaagtgactctgcccatctcggcagggtggtttcaccaaccaaggagcaagtatcagacacagaggacaaacagagaatgagggcagacgagatcaaagatgccatctacgtgaccatggagatcctgtccaactggggcaactcgtggtgggtgggtctcacagaagtcgagttctttgacttgaatgacacaaagctttatgtgtcgccccacgatgtggatatccggaacacagccacgcctggggagctgggccgcctcgtcaacaggaacttagctggcaagaaagactcctccccgtggacctgccccttccacccaccactccagctgttttttgttattcgaaacacaagacagctgggggacttccatctggccaagatcaaggttcggaattactggacagctgatggcgatcttgacattggtgccaagaacgtgaagctttacgtcaacagaaacctcatcttcaatggcaagttagacaaaggagatagggaggccccagctgaccacagcatcctggttgaccagaagaacgagaagagcgagcaactagaggaggccatgaacgctcactcggaagaaagcaaaggcacccatgagatggctggtgccagcggggacaaggagcttggtctcggttgctcaccgccagctgaaacattagcggatgcaaagctttcttcacaaggaaatgtgtctggcaaaagaaagaattctactaattgcaggaaagacagtttgtcccagttagaggaatatttgagactgtcggcagtccccacttcgatgggtgacatgcccagtgctcctgccacttccccacctgtgaagtgccctcctgtccatgaggagccctctctcatccaacaactggaaaacctcatgggcagaaaaatctgtgagccacccgggaaaaccccatcctggttacaaccttctcccaccggcaaggacaggaagcagggaggcaggaagccaaaacccctctggcttagtcccgagaagcccctggcctggaagggcaggctcccatcagacgatgtcatcggtgagggtcctggagagaccgaggccagggataaaggcctacggcatgagccagggtgggggaccagccggagtgtcaacaccaaggagagaccccagagggcaaccaccaaagtccacagtgatgactcagacatctttaaccagccccccaacagagagcgccctgctagtgggaggaggggctcaaggaaggatgctggcagcagtagtcatggggacgaccagccagccagcagagaagacacctggtcttccaggacgccgtcacggtcaaggtggcgcagtgagcaggagcacacacttcacgagtcatggagctccctcagtgccttcgaccgctcccaccggggacgcatctccaacacggagctcccgggggacatcctggatgagctcctgcagcaaaagagcagccggcacagcgacttgcccccctccaagaagggggagcagccagggctgtcgagagggcaggatggctactctggagagacagacgctgggggtgactttaaaatccccgtcttgccttatggacagcgcttggtcattgacatcaagtctacctggggggacagacactatgtcggcctcaacggaatagaaatattcagttccaagggtgaaccggtgcagatttcaaacataaaagcagaccctcccgatatcaatattttaccagcctatgggaaagacccccgcgtggtcaccaacctcatcgacggggtgaacaggacccaggatgacatgcatgtctggctggcccccttcacgcggggcagatcccactccatcaccattgacttcacgcacccttgccacgttgccctgatcagaatttggaactacaataaatctcggatacattccttccgaggcgtgaaggacatcacaatgctgttagacacccagtgcatctttgaaggagaaatcgccaaggcctctggaaccctggcgggagccccagagcactttggagacacgatcttattcacaaccgatgatgacattctcgaggccatattctattctgatgagatgtttgacctggatgtggggagcctggacagcctgcaggatgaagaggcaatgaggaggcccagcacggccgacggcgagggggatgagcggcccttcacccaggctggcttgggggctgatgaacggatcccggagctagagctcccatccagttcccctgtcccccaagtcaccacgccagagccaggcatctaccacggaatctgccttcagctgaatttcactgcctcctggggagacttgcactacctggggctcactggcctggaagtggtgggcaaggagggccaggcgctgcccatccacctgcaccagatctctgcttcccccagagacttaaatgagctccccgagtactctgacgactcccggaccctggacaagttaattgatggcaccaacatcaccatggaggatgagcatatgtggctgatccccttctcgccggggctggaccatgtggtcacgatccgcctggacagggccgaaagcatcgcaggcctgcgcttctggaactacaataaatctcccgaggacacctatcgcggggccaagattgtccacgtctccctggatggcctgtgcgtctccccgccagagggctttctcatccggaaggggccaggcaactgccactttgattttgctcaagaaatcctcttcgtggactacctacgggctcagctgctgccccagccggccaggaggctggacatgagaagcctggagtgtgcaagcatggactacgaggcaccgctgatgccctgtggcttcattttccagtttcagcttctcaccagctggggcgacccctactacatcggcctcaccggcctggagctgtatgacgagcgaggagaaaaaatccccttgtcggaaaacaatattgcggccttccccgacagcgtgaactccctggagggtgtgggcggggacgtccgcaccccagacaagctcatcgaccaagtgaacgacaccagtgatggccggcacatgtggctggctcccatcctgccgggcctggtgaaccgggtttatgtgattttcgatctgcctaccaccgtgtcaatgatcaaactgtggaattatgcgaaaacaccccatcgaggggtgaaggagtttggcctcctggtggacgacctgcttgtgtacaatgggatcctggccatggtgagccacctggtggggggcatcctgcccacatgtgagcccaccgtgccctaccacaccatcctcttcaccgaggacagggacatccgccaccaggagaaacacaccaccatcagtaatcaggccgaggatcaagatgtccagatgatgaatgaaaaccaaatcattaccaacgcgaaacggaagcagagcgttgttgacccagccttacgtcccaaaacctgcatcagcgagaaggagacgagacgacggcgctgctgactggtgaaggagggagagctggtcctcccactatggtgggctccgtcagcagccccactcagtgcctgcgtccctcaccctcagtcccaggagctggaagcgaaccacagtgttgaggggagcccgctgggaagaggggactcgggaggacagccctggatactaccagagtgacagatggctgtggctgcagggcaaagagatcccctgcagttctgggttggccacagggagcccaggacacccgccttcatgcctctgctgtgagacccagcaaagcagggcccatgaccactagggcctgggctgaccctgactcagaacaggacaatgacggggtggggaggcatcccatccagcctcagagggcccagagaatggctgagcaggacagtgggagaccagaccctaccccgcaactccagtaagcagggcactgcccagggagactgccttcagaaacctgagcttcagcggccaacaccccccatcccctgcgcatccttgtctcatttggggactggtggagctggctgagaggttggggtagtttcctggttacaggggtccacaagaccctctctcatcccggtataggggcctctctcctctcatcgggcctgataagggattggccaaggctgtgtgcatcctgcagagggaaggaagtcagctgggccacccgccatccaccttggcaagagctgggcccactctggcaggccagggtatcatctgcgtgctgctgccgggccaggaagggtgggtgggtggccagcaggctggcagctccagaccccagagggccagaagaactcaccccagtgccctctggatgcaggtgttggggaacactgaggacaatcccccatctcccctcacccttgagcaggccctccctgcactctctgccacatgtccctcctggtctgatcacggctgtgctcactgatgtggctgctttctgtctctgcccctgtgcccttggaggcaggcagtgaggtgctcctttcccaggcccccaccccttctcccccttcagccacttcccagcgagttggaaatgtgccttgcacccccagccgagtgaagcccagaacgcatctatatgcatcgatgtaacaagctcggatcagggacctaattggtttcccagtagtgggtaatttctcgttgcaaatattaatccgttgtttttctggcgcccagcccggcccgccgcagtactgtactcgaggtacgttcctatgcaaccgagagccccggcaaatacttcatgagcttagcagcctgggctcgagcagctatgcaaacgcgcttttcatttggagcacggggctgatgtgaagataagaattgtttctcctggagaaagatccatcatttctccagcttccaagcccccggcacctctgctcagctcccagatgtgacgagcacctcccgccagggggagtcaggggttgatcaaaccagctcttgtgacccaaaccagtgccgctgcattaaagggaggcccagctactccttcccagctgagatgtgggtacaggtcagatttgtcagggagatggcactaacacgacacaagctcactcccagaaccgcagctgatgtttataataatcgtatgtactgtgcaatttaggaggggaaaaaaaggctgtacaagctttaactctaaaataaatttctatttttttcctcttgcaaaattaataaaagatgttattaagaataaaaac

SEQ ID NO: 355095 - DNA, 3076 bp, Homo sapiens
cctctgcttctccaacccatgtgcagatcccggagctagagctcccatccagttcccctgtcccccaagtcaccacgccagagccaggcatctaccacggaatctgccttcagctgaatttcactgcctcctggggagacttgcactacctggggctcactggcctggaagtggtgggcaaggagggccaggcgctgcccatccacctgcaccagatctctgcttcccccagagacttaaatgagctccccgagtactctgacgactcccggaccctggacaagttaattgatggcaccaacatcaccatggaggatgagcatatgtggctgatccccttctcgccggggctggaccatgtggtcacgatccgcctggacagggccgaaagcatcgcaggcctgcgcttctggaactacaataaatctcccgaggacacctatcgcggggccaagattgtccacgtctccctggatggcctgtgcgtctccccgccagagggctttctcatccggaaggggccaggcaactgccactttgattttgctcaagaaatcctcttcgtggactacctacgggctcagctgctgccccagccggccaggaggctggacatgagaagcctggagtgtgcaagcatggactacgaggcaccgctgatgccctgtggcttcattttccagtttcagcttctcaccagctggggcgacccctactacatcggcctcaccggcctggagctgtatgacgagcgaggagaaaaaatccccttgtcggaaaacaatattgcggccttccccgacagcgtgaactccctggagggtgtgggcggggacgtccgcaccccagacaagctcatcgaccaagtgaacgacaccagtgatggccggcacatgtggctggctcccatcctgccgggcctggtgaaccgggtttatgtgattttcgatctgcctaccaccgtgtcaatgatcaaactgtggaattatgcgaaaacaccccatcgaggggtgaaggagtttggcctcctggtggacgacctgcttgtgtacaatgggatcctggccatggtgagccacctggtggggggcatcctgcccacatgtgagcccaccgtgccctaccacaccatcctcttcaccgaggacagggacatccgccaccaggagaaacacaccaccatcagtaatcaggccgaggatcaagatgtccagatgatgaatgaaaaccaaatcattaccaacgcgaaacggaagcagagcgttgttgacccagccttacgtcccaaaacctgcatcagcgagaaggagacgagacgacggcgctgctgactggtgaaggagggagagctggtcctcccactatggtgggctccgtcagcagccccactcagtgcctgcgtccctcaccctcagtcccaggagctggaagcgaaccacagtgttgaggggagcccgctgggaagaggggactcgggaggacagccctggatactaccagagtgacagatggctgtggctgcagggcaaagagatcccctgcagttctgggttggccacagggagcccaggacacccgccttcatgcctctgctgtgagacccagcaaagcagggcccatgaccactagggcctgggctgaccctgactcagaacaggacaatgacggggtggggaggcatcccatccagcctcagagggcccagagaatggctgagcaggacagtgggagaccagaccctaccccgcaactccagtaagcagggcactgcccagggagactgccttcagaaacctgagcttcagcggccaacaccccccatcccctgcgcatccttgtctcatttggggactggtggagctggctgagaggttggggtagtttcctggttacaggggtccacaagaccctctctcatcccggtataggggcctctctcctctcatcgggcctgataagggattggccaaggctgtgtgcatcctgcagagggaaggaagtcagctgggccacccgccatccaccttggcaagagctgggcccactctggcaggccagggtatcatctgcgtgctgctgccgggccaggaagggtgggtgggtggccagcaggctggcagctccagaccccagagggccagaagaactcaccccagtgccctctggatgcaggtgttggggaacactgaggacaatcccccatctcccctcacccttgagcaggccctccctgcactctctgccacatgtccctcctggtctgatcacggctgtgctcactgatgtggctgctttctgtctctgcccctgtgcccttggaggcaggcagtgaggtgctcctttcccaggcccccaccccttctcccccttcagccacttcccagcgagttggaaatgtgccttgcacccccagccgagtgaagcccagaacgcatctatatgcatcgatgtaacaagctcggatcagggacctaattggtttcccagtagtgggtaatttctcgttgcaaatattaatccgttgtttttctggcgcccagcccggcccgccgcagtactgtactcgaggtacgttcctatgcaaccgagagccccggcaaatacttcatgagcttagcagcctgggctcgagcagctatgcaaacgcgcttttcatttggagcacggggctgatgtgaagataagaattgtttctcctggagaaagatccatcatttctccagcttccaagcccccggcacctctgctcagctcccagatgtgacgagcacctcccgccagggggagtcaggggttgatcaaaccagctcttgtgacccaaaccagtgccgctgcattaaagggaggcccagctactccttcccagctgagatgtgggtacaggtcagatttgtcagggagatggcactaacacgacacaagctcactcccagaaccgcagctgatgtttataataatcgtatgtactgtgcaatttaggaggggaaaaaaaggctgtacaagctttaactctaaaataaatttctatttttttcctcttgcaaaattaataaaagatgttattaagaataaaaac

SEQ ID NO: 355096 - DNA, 1653 bp, Homo sapiens
agctcctcacctcagtccagactgaaagagcccgctgggaagaggggactcgggaggacagccctggatactaccagagtgacagatggctgtggctgcagggcaaagagatcccctgcagttctgggttggccacagggagcccaggacacccgccttcatgcctctgctgtgagacccagcaaagcagggcccatgaccactagggcctgggctgaccctgactcagaacaggacaatgacggggtggggaggcatcccatccagcctcagagggcccagagaatggctgagcaggacagtgggagaccagaccctaccccgcaactccagtaagcagggcactgcccagggagactgccttcagaaacctgagcttcagcggccaacaccccccatcccctgcgcatccttgtctcatttggggactggtggagctggctgagaggttggggtagtttcctggttacaggggtccacaagaccctctctcatcccggtataggggcctctctcctctcatcgggcctgataagggattggccaaggctgtgtgcatcctgcagagggaaggaagtcagctgggccacccgccatccaccttggcaagagctgggcccactctggcaggccagggtatcatctgcgtgctgctgccgggccaggaagggtgggtgggtggccagcaggctggcagctccagaccccagagggccagaagaactcaccccagtgccctctggatgcaggtgttggggaacactgaggacaatcccccatctcccctcacccttgagcaggccctccctgcactctctgccacatgtccctcctggtctgatcacggctgtgctcactgatgtggctgctttctgtctctgcccctgtgcccttggaggcaggcagtgaggtgctcctttcccaggcccccaccccttctcccccttcagccacttcccagcgagttggaaatgtgccttgcacccccagccgagtgaagcccagaacgcatctatatgcatcgatgtaacaagctcggatcagggacctaattggtttcccagtagtgggtaatttctcgttgcaaatattaatccgttgtttttctggcgcccagcccggcccgccgcagtactgtactcgaggtacgttcctatgcaaccgagagccccggcaaatacttcatgagcttagcagcctgggctcgagcagctatgcaaacgcgcttttcatttggagcacggggctgatgtgaagataagaattgtttctcctggagaaagatccatcatttctccagcttccaagcccccggcacctctgctcagctcccagatgtgacgagcacctcccgccagggggagtcaggggttgatcaaaccagctcttgtgacccaaaccagtgccgctgcattaaagggaggcccagctactccttcccagctgagatgtgggtacaggtcagatttgtcagggagatggcactaacacgacacaagctcactcccagaaccgcagctgatgtttataataatcgtatgtactgtgcaatttaggaggggaaaaaaaggctgtacaagctttaactctaaaataaatttctatttttttcctcttgcaaaattaataaaagatgttattaagaataaaaac

SEQ ID NO: 355097 - DNA, 5086 bp, Homo sapiens
taacctcgtacctgggttgacgtgagcttccggttcgagctcccggaaccgccgcctctagggatggacggtcagactctgcgaaaggccgagagaagctggtcctgctcacgagagaaaaaggagggttacgctaaggacatggtgacagactttgatgagaaacatgatgagtatttaatattgcttcagcagaggaaccggatattaaagcatttgaaaagcaaggaccccgtgcaattgaggctggagcacttggagcaaggtttctctgtctatgtcaacggtgccaattcggagctgaaatcatcaccgcggaaagctattcactctgacttctccagaagtgcctcccacacggaggggacacacgattatggacgaagaactctgtttcgagaagctgaagaagccttaagacgcagttcacggacagcccccagtaaagtccagcgccgaggatggcaccagaaatctgtgcagatcagaacagaagctggcccacggctccacatcgaacctcctgtggactattctgatgattttgagctgtgtggggatgtgactctccaggcaaacaacacttctgaggatcgtccgcaggataccaaatctcccaccagtaccaagccctgtggttttaacttctcccttctgaatgcatgtggacattctgacccttcaagcagcgtggacaaagaaaggatcctcttaactattcaggatgtgatggagctgagaagaagcctggaacttagtgtaaatctacaaaggaaacaaaaggattgttccagcgatgagtatgactctattgaggaagacatactctctgagcctgagccagaggacccggcactggtgggccatcccagacatgaccgccctccttccagtggcgactggactcagaaagatgttcacggggaacaggagacagaaggacgctcttctccaggcccagacaccctcgtggtgctggaatttaacccagcttccaaaagtcataaaagggaaaggaatttgtctgcaaagcggaaggacaatgctgaggttttcgttcccaccaaacctgagccaaacctgactccccaagctcctgctgtattcccagaccaggagaggatgtgctccagacctggaagccggcgagagagacccctgtctgcaacccgcaaaactctttgcgaggctgagtacccagaggaagatgcctctgctgtgctccaagccatccaggtggagaacgcagccctgcagagggcgctcctcagcagaaaggccgagcagccagccagcccactgcaggatgcagaaggaccaccagcaaaaccatggaccagtctgctggaggagaaggaagagacccttgagctgcttcccatcaccacggcgactactactcaggagccggccggggcagcaggaggagccagggccatcaaccaggccatggacagaattgggcttctgggaagcagacaacagcagaagcttctgaaagtcctccaggccgtcgaaagtgactctgcccatctcggcagggtggtttcaccaaccaaggagcaagtatcagacacagaggacaaacagagaatgagggcagacgagatcaaagatgccatctacgtgaccatggagatcctgtccaactggggcaactcgtggtgggtgggtctcacagaagtcgagttctttgacttgaatgacacaaagctttatgtgtcgccccacgatgtggatatccggaacacagccacgcctggggagctgggccgcctcgtcaacaggaacttagctggcaagaaagactcctccccgtggacctgccccttccacccaccactccagctgttttttgttattcgaaacacaagacagctgggggacttccatctggccaagatcaaggttcggaattactggacagctgatggcgatcttgacattggtgccaagaacgtgaagctttacgtcaacagaaacctcatcttcaatggcaagttagacaaaggagatagggaggccccagctgaccacagcatcctggttgaccagaagaacgagaagagcgagcaactagaggaggccatgaacgctcactcggaagaaagcaaaggcacccatgagatggctggtgccagcggggacaaggagcttggtctcggttgctcaccgccagctgaaacattagcggatgcaaagctttcttcacaaggaaatgtgtctggcaaaagaaagaattctactaattgcaggaaagacagtttgtcccagttagaggaatatttgagactgtcggcagtccccacttcgatgggtgacatgcccagtgctcctgccacttccccacctgtgaagtgccctcctgtccatgaggagccctctctcatccaacaactggaaaacctcatgggcagaaaaatctgtgagccacccgggaaaaccccatcctggttacaaccttctcccaccggcaaggacaggaagcagggaggcaggaagccaaaacccctctggcttagtcccgagaagcccctggcctggaagggcaggctcccatcagacgatgtcatcggtgagggtcctggagagaccgaggccagggataaaggcctacggcatgagccagggtgggggaccagccggagtgtcaacaccaaggagagaccccagagggcaaccaccaaagtccacagtgatgactcagacatctttaaccagccccccaacagagagcgccctgctagtgggaggaggggctcaaggaaggatgctggcagcagtagtcatggggacgaccagccagccagcagagaagacacctggtcttccaggacgccgtcacggtcaaggtggcgcagtgagcaggagcacacacttcacgagtcatggagctccctcagtgccttcgaccgctcccaccggggacgcatctccaacacggagctcccgggggacatcctggatgagctcctgcagcaaaagagcagccggcacagcgacttgcccccctccaagaagggggagcagccagggctgtcgagagggcaggatggctactctggagagacagacgctgggggtgactttaaaatccccgtcttgccttatggacagcgcttggtcattgacatcaagtctacctggggggacagacactatgtcggcctcaacggaatagaaatattcagttccaagggtgaaccggtgcagatttcaaacataaaagcagaccctcccgatatcaatattttaccagcctatgggaaagacccccgcgtggtcaccaacctcatcgacggggtgaacaggacccaggatgacatgcatgtctggctggcccccttcacgcggggcagatcccactccatcaccattgacttcacgcacccttgccacgttgccctgatcagaatttggaactacaataaatctcggatacattccttccgaggcgtgaaggacatcacaatgctgttagacacccagtgcatctttgaaggagaaatcgccaaggcctctggaaccctggcgggagccccagagcactttggagacacgatcttattcacaaccgatgatgacattctcgaggccatattctattctgatgagatgtttgacctggatgtggggagcctggacagcctgcaggatgaagaggcaatgaggaggcccagcacggccgacggcgagggggatgagcggcccttcacccaggctggcttgggggctgatgaacggatcccggagctagagctcccatccagttcccctgtcccccaagtcaccacgccagagccaggcatctaccacggaatctgccttcagctgaatttcactgcctcctggggagacttgcactacctggggctcactggcctggaagtggtgggcaaggagggccaggcgctgcccatccacctgcaccagatctctgcttcccccagagacttaaatgagctccccgagtactctgacgactcccggaccctggacaagttaattgatggcaccaacatcaccatggaggatgagcatatgtggctgatccccttctcgccggggctggaccatgtggtcacgatccgcctggacagggccgaaagcatcgcaggcctgcgcttctggaactacaataaatctcccgaggacacctatcgcggggccaagattgtccacgtctccctggatggcctgtgcgtctccccgccagagggctttctcatccggaaggggccaggcaactgccactttgattttgctcaagaaatcctcttcgtggactacctacgggctcagctgctgccccagccggccaggaggctggacatgagaagcctggagtgtgcaagcatggactacgaggcaccgctgatgccctgtggcttcattttccagtttcagcttctcaccagctggggcgacccctactacatcggcctcaccggcctggagctgtatgacgagcgaggagaaaaaatccccttgtcggaaaacaatattgcggccttccccgacagcgtgaactccctggagggtgtgggcggggacgtccgcaccccagacaagctcatcgaccaagtgaacgacaccagtgatggccggcacatgtggctggctcccatcctgccgggcctggtgaaccgggtttatgtgattttcgatctgcctaccaccgtgtcaatgatcaaactgtggaattatgcgaaaacaccccatcgaggggtgaaggagtttggcctcctggtggacgacctgcttgtgtacaatgggatcctggccatggtgagccacctggtggggggcatcctgcccacatgtgagcccaccgtgccctaccacaccatcctcttcaccgaggacagggacatccgccaccaggagaaacacaccaccatcagtaatcaggccgaggatcaagatgtccagatgatgaatgaaaaccaaatcattaccaacgcgaaacggaagcagagcgttgttgacccagccttacgtcccaaaacctgcatcgaggaggaagaggaaagcaccgagggccttgcaagactggagagcagaagaggctgggcgcgcttagctg

SEQ ID NO: 355098 - DNA, 707 bp, Homo sapiens
taacctcgtacctgggttgacgtgagcttccggttcgagctcccggaaccgccgcctctagggatggacggtcagactctgcgaaaggccgagagaagctggtcctgctcacgagagaaaaaggagggttacgctaaggacatggtgacagactttgatgagaaacatgatgagtatttaatattgcttcagcagaggaaccggatattaaagcatttgaaaagcaaggaccccgtgcaattgaggctggagcacttggagcaaggtttctctgtctatgtcaacggtgccaattcggagctgaaatcatcaccgcggaaagctattcactctgacttctccagaagtgcctcccacacggaggggacacacgattatggacgaagaactctgtttcgagaagctgaagaagccttaagacgcagttcacggacagcccccagtaaagtccagcgccgaggatggcaccaggtctggagactgtggccccagcccacgctttagaatacagagtgtgggtggctgtgggaatagaaatacaatcagagcatttaaaacccccatgggccaggcacagtggctcctttatgcaatcccagcattttgggagggtgaggtgggaggatcactttgagcccagaagttcgagaccagcttgggcaacaaagtgagacttcatctctactaaaaataaaaataaaaaattc

SEQ ID NO: 355099 - DNA, 6665 bp, Homo sapiens
taacctcgtacctgggttgacgtgagcttccggttcgagctcccggaaccgccgcctctagggatggacggtcagactctgcgaaaggccgagagaagctggtcctgctcacgagagaaaaaggagggttacgctaaggacatggtgacagactttgatgagaaacatgatgagtatttaatattgcttcagcagaggaaccggatattaaagcatttgaaaagcaaggaccccgtgcaattgaggctggagcacttggagcaaggtttctctgtctatgtcaacggtgccaattcggagctgaaatcatcaccgcggaaagctattcactctgacttctccagaagtgcctcccacacggaggggacacacgattatggacgaagaactctgtttcgagaagctgaagaagccttaagacgcagttcacggacagcccccagtaaagtccagcgccgaggatggcaccagaaatctgtgcagatcagaacagaagctggcccacggctccacatcgaacctcctgtggactattctgatgattttgagctgtgtggggatgtgactctccaggcaaacaacacttctgaggatcgtccgcaggagctgagaagaagcctggaacttagtgtaaatctacaaaggaaacaaaaggattgttccagcgatgagtatgactctattgaggaagacatactctctgagcctgagccagaggacccggcactggtgggccatcccagacatgaccgccctccttccagtggcgactggactcagaaagatgttcacggggaacaggagacagaaggacgctcttctccaggcccagacaccctcgtggtgctggaatttaacccagcttccaaaagtcataaaagggaaaggaatttgtctgcaaagcggaaggacaatgctgaggttttcgttcccaccaaacctgagccaaacctgactccccaagctcctgctgtattcccagaccaggagaggatgtgctccagacctggaagccggcgagagagacccctgtctgcaacccgcaaaactctttgcgaggctgagtacccagaggaagatgcctctgctgtgctccaagccatccaggtggagaacgcagccctgcagagggcgctcctcagcagaaaggccgagcagccagccagcccactgcaggatgcagaaggaccaccagcaaaaccatggaccagtctgctggaggagaaggaagagacccttgagctgcttcccatcaccacggcgactactactcaggagccggccggggcagcaggaggagccagggccatcaaccaggccatggacagaattgggcttctgggaagcagacaacagcagaagcttctgaaagtcctccaggccgtcgaaagtgactctgcccatctcggcagggtggtttcaccaaccaaggagcaagtatcagacacagaggacaaacagagaatgagggcagacgagatcaaagatgccatctacgtgaccatggagatcctgtccaactggggcaactcgtggtgggtgggtctcacagaagtcgagttctttgacttgaatgacacaaagctttatgtgtcgccccacgatgtggatatccggaacacagccacgcctggggagctgggccgcctcgtcaacaggaacttagctggcaagaaagactcctccccgtggacctgccccttccacccaccactccagctgttttttgttattcgaaacacaagacagctgggggacttccatctggccaagatcaaggttcggaattactggacagctgatggcgatcttgacattggtgccaagaacgtgaagctttacgtcaacagaaacctcatcttcaatggcaagttagacaaaggagatagggaggccccagctgaccacagcatcctggttgaccagaagaacgagaagagcgagcaactagaggaggccatgaacgctcactcggaagaaagcaaaggcacccatgagatggctggtgccagcggggacaaggagcttggtctcggttgctcaccgccagctgaaacattagcggatgcaaagctttcttcacaaggaaatgtgtctggcaaaagaaagaattctactaattgcaggaaagacagtttgtcccagttagaggaatatttgagactgtcggcagtccccacttcgatgggtgacatgcccagtgctcctgccacttccccacctgtgaagtgccctcctgtccatgaggagccctctctcatccaacaactggaaaacctcatgggcagaaaaatctgtgagccacccgggaaaaccccatcctggttacaaccttctcccaccggcaaggacaggaagcagggaggcaggaagccaaaacccctctggcttagtcccgagaagcccctggcctggaagggcaggctcccatcagacgatgtcatcggtgagggtcctggagagaccgaggccagggataaaggcctacggcatgagccagggtgggggaccagccggagtgtcaacaccaaggagagaccccagagggcaaccaccaaagtccacagtgatgactcagacatctttaaccagccccccaacagagagcgccctgctagtgggaggaggggctcaaggaaggatgctggcagcagtagtcatggggacgaccagccagccagcagagaagacacctggtcttccaggacgccgtcacggtcaaggtggcgcagtgagcaggagcacacacttcacgagtcatggagctccctcagtgccttcgaccgctcccaccggggacgcatctccaacacggagctcccgggggacatcctggatgagctcctgcagcaaaagagcagccggcacagcgacttgcccccctccaagaagggggagcagccagggctgtcgagagggcaggatggctactctggagagacagacgctgggggtgactttaaaatccccgtcttgccttatggacagcgcttggtcattgacatcaagtctacctggggggacagacactatgtcggcctcaacggaatagaaatattcagttccaagggtgaaccggtgcagatttcaaacataaaagcagaccctcccgatatcaatattttaccagcctatgggaaagacccccgcgtggtcaccaacctcatcgacggggtgaacaggacccaggatgacatgcatgtctggctggcccccttcacgcggggcagatcccactccatcaccattgacttcacgcacccttgccacgttgccctgatcagaatttggaactacaataaatctcggatacattccttccgaggcgtgaaggacatcacaatgctgttagacacccagtgcatctttgaaggagaaatcgccaaggcctctggaaccctggcgggagccccagagcactttggagacacgatcttattcacaaccgatgatgacattctcgaggccatattctattctgatgagatgtttgacctggatgtggggagcctggacagcctgcaggatgaagaggcaatgaggaggcccagcacggccgacggcgagggggatgagcggcccttcacccaggctggcttgggggctgatgaacggatcccggagctagagctcccatccagttcccctgtcccccaagtcaccacgccagagccaggcatctaccacggaatctgccttcagctgaatttcactgcctcctggggagacttgcactacctggggctcactggcctggaagtggtgggcaaggagggccaggcgctgcccatccacctgcaccagatctctgcttcccccagagacttaaatgagctccccgagtactctgacgactcccggaccctggacaagttaattgatggcaccaacatcaccatggaggatgagcatatgtggctgatccccttctcgccggggctggaccatgtggtcacgatccgcctggacagggccgaaagcatcgcaggcctgcgcttctggaactacaataaatctcccgaggacacctatcgcggggccaagattgtccacgtctccctggatggcctgtgcgtctccccgccagagggctttctcatccggaaggggccaggcaactgccactttgattttgctcaagaaatcctcttcgtggactacctacgggctcagctgctgccccagccggccaggaggctggacatgagaagcctggagtgtgcaagcatggactacgaggcaccgctgatgccctgtggcttcattttccagtttcagcttctcaccagctggggcgacccctactacatcggcctcaccggcctggagctgtatgacgagcgaggagaaaaaatccccttgtcggaaaacaatattgcggccttccccgacagcgtgaactccctggagggtgtgggcggggacgtccgcaccccagacaagctcatcgaccaagtgaacgacaccagtgatggccggcacatgtggctggctcccatcctgccgggcctggtgaaccgggtttatgtgattttcgatctgcctaccaccgtgtcaatgatcaaactgtggaattatgcgaaaacaccccatcgaggggtgaaggagtttggcctcctggtggacgacctgcttgtgtacaatgggatcctggccatggtgagccacctggtggggggcatcctgcccacatgtgagcccaccgtgccctaccacaccatcctcttcaccgaggacagggacatccgccaccaggagaaacacaccaccatcagtaatcaggccgaggatcaagatgtccagatgatgaatgaaaaccaaatcattaccaacgcgaaacggaagcagagcgttgttgacccagccttacgtcccaaaacctgcatcagcgagaaggagacgagacgacggcgctgctgactggtgaaggagggagagctggtcctcccactatggtgggctccgtcagcagccccactcagtgcctgcgtccctcaccctcagtcccaggagctggaagcgaaccacagtgttgaggggagcccgctgggaagaggggactcgggaggacagccctggatactaccagagtgacagatggctgtggctgcagggcaaagagatcccctgcagttctgggttggccacagggagcccaggacacccgccttcatgcctctgctgtgagacccagcaaagcagggcccatgaccactagggcctgggctgaccctgactcagaacaggacaatgacggggtggggaggcatcccatccagcctcagagggcccagagaatggctgagcaggacagtgggagaccagaccctaccccgcaactccagtaagcagggcactgcccagggagactgccttcagaaacctgagcttcagcggccaacaccccccatcccctgcgcatccttgtctcatttggggactggtggagctggctgagaggttggggtagtttcctggttacaggggtccacaagaccctctctcatcccggtataggggcctctctcctctcatcgggcctgataagggattggccaaggctgtgtgcatcctgcagagggaaggaagtcagctgggccacccgccatccaccttggcaagagctgggcccactctggcaggccagggtatcatctgcgtgctgctgccgggccaggaagggtgggtgggtggccagcaggctggcagctccagaccccagagggccagaagaactcaccccagtgccctctggatgcaggtgttggggaacactgaggacaatcccccatctcccctcacccttgagcaggccctccctgcactctctgccacatgtccctcctggtctgatcacggctgtgctcactgatgtggctgctttctgtctctgcccctgtgcccttggaggcaggcagtgaggtgctcctttcccaggcccccaccccttctcccccttcagccacttcccagcgagttggaaatgtgccttgcacccccagccgagtgaagcccagaacgcatctatatgcatcgatgtaacaagctcggatcagggacctaattggtttcccagtagtgggtaatttctcgttgcaaatattaatccgttgtttttctggcgcccagcccggcccgccgcagtactgtactcgaggtacgttcctatgcaaccgagagccccggcaaatacttcatgagcttagcagcctgggctcgagcagctatgcaaacgcgcttttcatttggagcacggggctgatgtgaagataagaattgtttctcctggagaaagatccatcatttctccagcttccaagcccccggcacctctgctcagctcccagatgtgacgagcacctcccgccagggggagtcaggggttgatcaaaccagctcttgtgacccaaaccagtgccgctgcattaaagggaggcccagctactccttcccagctgagatgtgggtacaggtcagatttgtcagggagatggcactaacacgacacaagctcactcccagaaccgcagctgatgtttataataatcgtatgtactgtgcaatttaggaggggaaaaaaaggctgtacaagctttaactctaaaataaatttctatttttttcctcttgcaaaattaataaaagatgttattaagaataaaaac

SEQ ID NO: 355100 - DNA, 6462 bp, Homo sapiens
tcgtcttaggcttcttcagcttctcgaaacagagtcttcgtccataatcgtgtgtcccctccgtgtgggaggcacttctggagaagtcagagtgaatagctttccgcggtgatgatttcagcgccgaggatggcaccagaaatctgtgcagatcagaacagaagctggcccacggctccacatcgaacctcctgtggactattctgatgattttgagctgtgtggggatgtgactctccaggcaaacaacacttctgaggatcgtccgcaggataccaaatctcccaccagtaccaagccctgtggttttaacttctcccttctgaatgcatgtggacattctgacccttcaagcagcgtggacaaagaaaggatcctcttaactattcaggatgtgatggagctgagaagaagcctggaacttagtgtaaatctacaaaggaaacaaaaggattgttccagcgatgagtatgactctattgaggaagacatactctctgagcctgagccagaggacccggcactggtgggccatcccagacatgaccgccctccttccagtggcgactggactcagaaagatgttcacggggaacaggagacagaaggacgctcttctccaggcccagacaccctcgtggtgctggaatttaacccagcttccaaaagtcataaaagggaaaggaatttgtctgcaaagcggaaggacaatgctgaggttttcgttcccaccaaacctgagccaaacctgactccccaagctcctgctgtattcccagaccaggagaggatgtgctccagacctggaagccggcgagagagacccctgtctgcaacccgcaaaactctttgcgaggctgagtacccagaggaagatgcctctgctgtgctccaagccatccaggtggagaacgcagccctgcagagggcgctcctcagcagaaaggccgagcagccagccagcccactgcaggatgcagaaggaccaccagcaaaaccatggaccagtctgctggaggagaaggaagagacccttgagctgcttcccatcaccacggcgactactactcaggagccggccggggcagcaggaggagccagggccatcaaccaggccatggacagaattgggcttctgggaagcagacaacagcagaagcttctgaaagtcctccaggccgtcgaaagtgactctgcccatctcggcagggtggtttcaccaaccaaggagcaagtatcagacacagaggacaaacagagaatgagggcagacgagatcaaagatgccatctacgtgaccatggagatcctgtccaactggggcaactcgtggtgggtgggtctcacagaagtcgagttctttgacttgaatgacacaaagctttatgtgtcgccccacgatgtggatatccggaacacagccacgcctggggagctgggccgcctcgtcaacaggaacttagctggcaagaaagactcctccccgtggacctgccccttccacccaccactccagctgttttttgttattcgaaacacaagacagctgggggacttccatctggccaagatcaaggttcggaattactggacagctgatggcgatcttgacattggtgccaagaacgtgaagctttacgtcaacagaaacctcatcttcaatggcaagttagacaaaggagatagggaggccccagctgaccacagcatcctggttgaccagaagaacgagaagagcgagcaactagaggaggccatgaacgctcactcggaagaaagcaaaggcacccatgagatggctggtgccagcggggacaaggagcttggtctcggttgctcaccgccagctgaaacattagcggatgcaaagctttcttcacaaggaaatgtgtctggcaaaagaaagaattctactaattgcaggaaagacagtttgtcccagttagaggaatatttgagactgtcggcagtccccacttcgatgggtgacatgcccagtgctcctgccacttccccacctgtgaagtgccctcctgtccatgaggagccctctctcatccaacaactggaaaacctcatgggcagaaaaatctgtgagccacccgggaaaaccccatcctggttacaaccttctcccaccggcaaggacaggaagcagggaggcaggaagccaaaacccctctggcttagtcccgagaagcccctggcctggaagggcaggctcccatcagacgatgtcatcggtgagggtcctggagagaccgaggccagggataaaggcctacggcatgagccagggtgggggaccagccggagtgtcaacaccaaggagagaccccagagggcaaccaccaaagtccacagtgatgactcagacatctttaaccagccccccaacagagagcgccctgctagtgggaggaggggctcaaggaaggatgctggcagcagtagtcatggggacgaccagccagccagcagagaagacacctggtcttccaggacgccgtcacggtcaaggtggcgcagtgagcaggagcacacacttcacgagtcatggagctccctcagtgccttcgaccgctcccaccggggacgcatctccaacacggagctcccgggggacatcctggatgagctcctgcagcaaaagagcagccggcacagcgacttgcccccctccaagaagggggagcagccagggctgtcgagagggcaggatggctactctggagagacagacgctgggggtgactttaaaatccccgtcttgccttatggacagcgcttggtcattgacatcaagtctacctggggggacagacactatgtcggcctcaacggaatagaaatattcagttccaagggtgaaccggtgcagatttcaaacataaaagcagaccctcccgatatcaatattttaccagcctatgggaaagacccccgcgtggtcaccaacctcatcgacggggtgaacaggacccaggatgacatgcatgtctggctggcccccttcacgcggggcagatcccactccatcaccattgacttcacgcacccttgccacgttgccctgatcagaatttggaactacaataaatctcggatacattccttccgaggcgtgaaggacatcacaatgctgttagacacccagtgcatctttgaaggagaaatcgccaaggcctctggaaccctggcgggagccccagagcactttggagacacgatcttattcacaaccgatgatgacattctcgaggccatattctattctgatgagatgtttgacctggatgtggggagcctggacagcctgcaggatgaagaggcaatgaggaggcccagcacggccgacggcgagggggatgagcggcccttcacccaggctggcttgggggctgatgaacggatcccggagctagagctcccatccagttcccctgtcccccaagtcaccacgccagagccaggcatctaccacggaatctgccttcagctgaatttcactgcctcctggggagacttgcactacctggggctcactggcctggaagtggtgggcaaggagggccaggcgctgcccatccacctgcaccagatctctgcttcccccagagacttaaatgagctccccgagtactctgacgactcccggaccctggacaagttaattgatggcaccaacatcaccatggaggatgagcatatgtggctgatccccttctcgccggggctggaccatgtggtcacgatccgcctggacagggccgaaagcatcgcaggcctgcgcttctggaactacaataaatctcccgaggacacctatcgcggggccaagattgtccacgtctccctggatggcctgtgcgtctccccgccagagggctttctcatccggaaggggccaggcaactgccactttgattttgctcaagaaatcctcttcgtggactacctacgggctcagctgctgccccagccggccaggaggctggacatgagaagcctggagtgtgcaagcatggactacgaggcaccgctgatgccctgtggcttcattttccagtttcagcttctcaccagctggggcgacccctactacatcggcctcaccggcctggagctgtatgacgagcgaggagaaaaaatccccttgtcggaaaacaatattgcggccttccccgacagcgtgaactccctggagggtgtgggcggggacgtccgcaccccagacaagctcatcgaccaagtgaacgacaccagtgatggccggcacatgtggctggctcccatcctgccgggcctggtgaaccgggtttatgtgattttcgatctgcctaccaccgtgtcaatgatcaaactgtggaattatgcgaaaacaccccatcgaggggtgaaggagtttggcctcctggtggacgacctgcttgtgtacaatgggatcctggccatggtgagccacctggtggggggcatcctgcccacatgtgagcccaccgtgccctaccacaccatcctcttcaccgaggacagggacatccgccaccaggagaaacacaccaccatcagtaatcaggccgaggatcaagatgtccagatgatgaatgaaaaccaaatcattaccaacgcgaaacggaagcagagcgttgttgacccagccttacgtcccaaaacctgcatcagcgagaaggagacgagacgacggcgctgctgactggtgaaggagggagagctggtcctcccactatggtgggctccgtcagcagccccactcagtgcctgcgtccctcaccctcagtcccaggagctggaagcgaaccacagtgttgaggggagcccgctgggaagaggggactcgggaggacagccctggatactaccagagtgacagatggctgtggctgcagggcaaagagatcccctgcagttctgggttggccacagggagcccaggacacccgccttcatgcctctgctgtgagacccagcaaagcagggcccatgaccactagggcctgggctgaccctgactcagaacaggacaatgacggggtggggaggcatcccatccagcctcagagggcccagagaatggctgagcaggacagtgggagaccagaccctaccccgcaactccagtaagcagggcactgcccagggagactgccttcagaaacctgagcttcagcggccaacaccccccatcccctgcgcatccttgtctcatttggggactggtggagctggctgagaggttggggtagtttcctggttacaggggtccacaagaccctctctcatcccggtataggggcctctctcctctcatcgggcctgataagggattggccaaggctgtgtgcatcctgcagagggaaggaagtcagctgggccacccgccatccaccttggcaagagctgggcccactctggcaggccagggtatcatctgcgtgctgctgccgggccaggaagggtgggtgggtggccagcaggctggcagctccagaccccagagggccagaagaactcaccccagtgccctctggatgcaggtgttggggaacactgaggacaatcccccatctcccctcacccttgagcaggccctccctgcactctctgccacatgtccctcctggtctgatcacggctgtgctcactgatgtggctgctttctgtctctgcccctgtgcccttggaggcaggcagtgaggtgctcctttcccaggcccccaccccttctcccccttcagccacttcccagcgagttggaaatgtgccttgcacccccagccgagtgaagcccagaacgcatctatatgcatcgatgtaacaagctcggatcagggacctaattggtttcccagtagtgggtaatttctcgttgcaaatattaatccgttgtttttctggcgcccagcccggcccgccgcagtactgtactcgaggtacgttcctatgcaaccgagagccccggcaaatacttcatgagcttagcagcctgggctcgagcagctatgcaaacgcgcttttcatttggagcacggggctgatgtgaagataagaattgtttctcctggagaaagatccatcatttctccagcttccaagcccccggcacctctgctcagctcccagatgtgacgagcacctcccgccagggggagtcaggggttgatcaaaccagctcttgtgacccaaaccagtgccgctgcattaaagggaggcccagctactccttcccagctgagatgtgggtacaggtcagatttgtcagggagatggcactaacacgacacaagctcactcccagaaccgcagctgatgtttataataatcgtatgtactgtgcaatttaggaggggaaaaaaaggctgtacaagctttaactctaaaataaatttctatttttttcctcttgcaaaattaataaaagatgttattaagaataaaaac

SEQ ID NO: 355101 - DNA, 5578 bp, Homo sapiens
gctccaggcagttgctgtcaccctcacattcctgttcctgttttctacaaagggactgtcagcctgagcatgcctgcccttgaccgtgaccctgctgtgtcttaggccaggagtgttgcctgagacatctgtttaataagcctttccatcctcagctgcttcccatcaccacggcgactactactcaggagccggccggggcagcaggaggagccagggccatcaaccaggccatggacagaattgggcttctgggaagcagacaacagcagaagcttctgaaagtcctccaggccgtcgaaagtgactctgcccatctcggcagggtggtttcaccaaccaaggagcaagtatcagacacagaggacaaacagagaatgagggcagacgagatcaaagatgccatctacgtgaccatggagatcctgtccaactggggcaactcgtggtgggtgggtctcacagaagtcgagttctttgacttgaatgacacaaagctttatgtgtcgccccacgatgtggatatccggaacacagccacgcctggggagctgggccgcctcgtcaacaggaacttagctggcaagaaagactcctccccgtggacctgccccttccacccaccactccagctgttttttgttattcgaaacacaagacagctgggggacttccatctggccaagatcaaggttcggaattactggacagctgatggcgatcttgacattggtgccaagaacgtgaagctttacgtcaacagaaacctcatcttcaatggcaagttagacaaaggagatagggaggccccagctgaccacagcatcctggttgaccagaagaacgagaagagcgagcaactagaggaggccatgaacgctcactcggaagaaagcaaaggcacccatgagatggctggtgccagcggggacaaggagcttggtctcggttgctcaccgccagctgaaacattagcggatgcaaagctttcttcacaaggaaatgtgtctggcaaaagaaagaattctactaattgcaggaaagacagtttgtcccagttagaggaatatttgagactgtcggcagtccccacttcgatgggtgacatgcccagtgctcctgccacttccccacctgtgaagtgccctcctgtccatgaggagccctctctcatccaacaactggaaaacctcatgggcagaaaaatctgtgagccacccgggaaaaccccatcctggttacaaccttctcccaccggcaaggacaggaagcagggaggcaggaagccaaaacccctctggcttagtcccgagaagcccctggcctggaagggcaggctcccatcagacgatgtcatcggtgagggtcctggagagaccgaggccagggataaaggcctacggcatgagccagggtgggggaccagccggagtgtcaacaccaaggagagaccccagagggcaaccaccaaagtccacagtgatgactcagacatctttaaccagccccccaacagagagcgccctgctagtgggaggaggggctcaaggaaggatgctggcagcagtagtcatggggacgaccagccagccagcagagaagacacctggtcttccaggacgccgtcacggtcaaggtggcgcagtgagcaggagcacacacttcacgagtcatggagctccctcagtgccttcgaccgctcccaccggggacgcatctccaacacggagctcccgggggacatcctggatgagctcctgcagcaaaagagcagccggcacagcgacttgcccccctccaagaagggggagcagccagggctgtcgagagggcaggatggctactctggagagacagacgctgggggtgactttaaaatccccgtcttgccttatggacagcgcttggtcattgacatcaagtctacctggggggacagacactatgtcggcctcaacggaatagaaatattcagttccaagggtgaaccggtgcagatttcaaacataaaagcagaccctcccgatatcaatattttaccagcctatgggaaagacccccgcgtggtcaccaacctcatcgacggggtgaacaggacccaggatgacatgcatgtctggctggcccccttcacgcggggcagatcccactccatcaccattgacttcacgcacccttgccacgttgccctgatcagaatttggaactacaataaatctcggatacattccttccgaggcgtgaaggacatcacaatgctgttagacacccagtgcatctttgaaggagaaatcgccaaggcctctggaaccctggcgggagccccagagcactttggagacacgatcttattcacaaccgatgatgacattctcgaggccatattctattctgatgagatgtttgacctggatgtggggagcctggacagcctgcaggatgaagaggcaatgaggaggcccagcacggccgacggcgagggggatgagcggcccttcacccaggctggcttgggggctgatgaacggatcccggagctagagctcccatccagttcccctgtcccccaagtcaccacgccagagccaggcatctaccacggaatctgccttcagctgaatttcactgcctcctggggagacttgcactacctggggctcactggcctggaagtggtgggcaaggagggccaggcgctgcccatccacctgcaccagatctctgcttcccccagagacttaaatgagctccccgagtactctgacgactcccggaccctggacaagttaattgatggcaccaacatcaccatggaggatgagcatatgtggctgatccccttctcgccggggctggaccatgtggtcacgatccgcctggacagggccgaaagcatcgcaggcctgcgcttctggaactacaataaatctcccgaggacacctatcgcggggccaagattgtccacgtctccctggatggcctgtgcgtctccccgccagagggctttctcatccggaaggggccaggcaactgccactttgattttgctcaagaaatcctcttcgtggactacctacgggctcagctgctgccccagccggccaggaggctggacatgagaagcctggagtgtgcaagcatggactacgaggcaccgctgatgccctgtggcttcattttccagtttcagcttctcaccagctggggcgacccctactacatcggcctcaccggcctggagctgtatgacgagcgaggagaaaaaatccccttgtcggaaaacaatattgcggccttccccgacagcgtgaactccctggagggtgtgggcggggacgtccgcaccccagacaagctcatcgaccaagtgaacgacaccagtgatggccggcacatgtggctggctcccatcctgccgggcctggtgaaccgggtttatgtgattttcgatctgcctaccaccgtgtcaatgatcaaactgtggaattatgcgaaaacaccccatcgaggggtgaaggagtttggcctcctggtggacgacctgcttgtgtacaatgggatcctggccatggtgagccacctggtggggggcatcctgcccacatgtgagcccaccgtgccctaccacaccatcctcttcaccgaggacagggacatccgccaccaggagaaacacaccaccatcagtaatcaggccgaggatcaagatgtccagatgatgaatgaaaaccaaatcattaccaacgcgaaacggaagcagagcgttgttgacccagccttacgtcccaaaacctgcatcagcgagaaggagacgagacgacggcgctgctgactggtgaaggagggagagctggtcctcccactatggtgggctccgtcagcagccccactcagtgcctgcgtccctcaccctcagtcccaggagctggaagcgaaccacagtgttgaggggagcccgctgggaagaggggactcgggaggacagccctggatactaccagagtgacagatggctgtggctgcagggcaaagagatcccctgcagttctgggttggccacagggagcccaggacacccgccttcatgcctctgctgtgagacccagcaaagcagggcccatgaccactagggcctgggctgaccctgactcagaacaggacaatgacggggtggggaggcatcccatccagcctcagagggcccagagaatggctgagcaggacagtgggagaccagaccctaccccgcaactccagtaagcagggcactgcccagggagactgccttcagaaacctgagcttcagcggccaacaccccccatcccctgcgcatccttgtctcatttggggactggtggagctggctgagaggttggggtagtttcctggttacaggggtccacaagaccctctctcatcccggtataggggcctctctcctctcatcgggcctgataagggattggccaaggctgtgtgcatcctgcagagggaaggaagtcagctgggccacccgccatccaccttggcaagagctgggcccactctggcaggccagggtatcatctgcgtgctgctgccgggccaggaagggtgggtgggtggccagcaggctggcagctccagaccccagagggccagaagaactcaccccagtgccctctggatgcaggtgttggggaacactgaggacaatcccccatctcccctcacccttgagcaggccctccctgcactctctgccacatgtccctcctggtctgatcacggctgtgctcactgatgtggctgctttctgtctctgcccctgtgcccttggaggcaggcagtgaggtgctcctttcccaggcccccaccccttctcccccttcagccacttcccagcgagttggaaatgtgccttgcacccccagccgagtgaagcccagaacgcatctatatgcatcgatgtaacaagctcggatcagggacctaattggtttcccagtagtgggtaatttctcgttgcaaatattaatccgttgtttttctggcgcccagcccggcccgccgcagtactgtactcgaggtacgttcctatgcaaccgagagccccggcaaatacttcatgagcttagcagcctgggctcgagcagctatgcaaacgcgcttttcatttggagcacggggctgatgtgaagataagaattgtttctcctggagaaagatccatcatttctccagcttccaagcccccggcacctctgctcagctcccagatgtgacgagcacctcccgccagggggagtcaggggttgatcaaaccagctcttgtgacccaaaccagtgccgctgcattaaagggaggcccagctactccttcccagctgagatgtgggtacaggtcagatttgtcagggagatggcactaacacgacacaagctcactcccagaaccgcagctgatgtttataataatcgtatgtactgtgcaatttaggaggggaaaaaaaggctgtacaagctttaactctaaaataaatttctatttttttcctcttgcaaaattaataaaagatgttattaagaataaaaac

SEQ ID NO: 355102 - DNA, 2354 bp, Homo sapiens
ttgttgcaaatgcagccacacgtgacctgactcaagatgggcttcgaggagatgaaagggggcggaactccaggctggcccacgtggcaggcgctgccttgggcaccaccgctcaccccagcccacgcctggcacccccagcccagccaagcgcctctgtttccaaacatgcctgttttaattagtgccgctctctgacaggtgaaccgggtttatgtgattttcgatctgcctaccaccgtgtcaatgatcaaactgtggaattatgcgaaaacaccccatcgaggggtgaaggagtttggcctcctggtggacgacctgcttgtgtacaatgggatcctggccatggtgagccacctggtggggggcatcctgcccacatgtgagcccaccgtgccctaccacaccatcctcttcaccgaggacagggacatccgccaccaggagaaacacaccaccatcagtaatcaggccgaggatcaagatgtccagatgatgaatgaaaaccaaatcattaccaacgcgaaacggaagcagagcgttgttgacccagccttacgtcccaaaacctgcatcagcgagaaggagacgagacgacggcgctgctgactggtgaaggagggagagctggtcctcccactatggtgggctccgtcagcagccccactcagtgcctgcgtccctcaccctcagtcccaggagctggaagcgaaccacagtgttgaggggagcccgctgggaagaggggactcgggaggacagccctggatactaccagagtgacagatggctgtggctgcagggcaaagagatcccctgcagttctgggttggccacagggagcccaggacacccgccttcatgcctctgctgtgagacccagcaaagcagggcccatgaccactagggcctgggctgaccctgactcagaacaggacaatgacggggtggggaggcatcccatccagcctcagagggcccagagaatggctgagcaggacagtgggagaccagaccctaccccgcaactccagtaagcagggcactgcccagggagactgccttcagaaacctgagcttcagcggccaacaccccccatcccctgcgcatccttgtctcatttggggactggtggagctggctgagaggttggggtagtttcctggttacaggggtccacaagaccctctctcatcccggtataggggcctctctcctctcatcgggcctgataagggattggccaaggctgtgtgcatcctgcagagggaaggaagtcagctgggccacccgccatccaccttggcaagagctgggcccactctggcaggccagggtatcatctgcgtgctgctgccgggccaggaagggtgggtgggtggccagcaggctggcagctccagaccccagagggccagaagaactcaccccagtgccctctggatgcaggtgttggggaacactgaggacaatcccccatctcccctcacccttgagcaggccctccctgcactctctgccacatgtccctcctggtctgatcacggctgtgctcactgatgtggctgctttctgtctctgcccctgtgcccttggaggcaggcagtgaggtgctcctttcccaggcccccaccccttctcccccttcagccacttcccagcgagttggaaatgtgccttgcacccccagccgagtgaagcccagaacgcatctatatgcatcgatgtaacaagctcggatcagggacctaattggtttcccagtagtgggtaatttctcgttgcaaatattaatccgttgtttttctggcgcccagcccggcccgccgcagtactgtactcgaggtacgttcctatgcaaccgagagccccggcaaatacttcatgagcttagcagcctgggctcgagcagctatgcaaacgcgcttttcatttggagcacggggctgatgtgaagataagaattgtttctcctggagaaagatccatcatttctccagcttccaagcccccggcacctctgctcagctcccagatgtgacgagcacctcccgccagggggagtcaggggttgatcaaaccagctcttgtgacccaaaccagtgccgctgcattaaagggaggcccagctactccttcccagctgagatgtgggtacaggtcagatttgtcagggagatggcactaacacgacacaagctcactcccagaaccgcagctgatgtttataataatcgtatgtactgtgcaatttaggaggggaaaaaaaggctgtacaagctttaactctaaaataaatttctatttttttcctcttgcaaaattaataaaagatgttattaagaataaaaac

SEQ ID NO: 355103 - DNA, 1991 bp, Homo sapiens
taacctcgtacctgggttgacgtgagcttccggttcgagctcccggaaccgccgcctctagggatggacggtcagactctgcgaaaggccgagagaagctggtcctgctcacgagagaaaaaggagggttacgctaaggacatggtgacagactttgatgagaaacatgatgagtatttaatattgcttcagcagaggaaccggatattaaagcatttgaaaagcaaggaccccgtgcaattgaggctggagcacttggagcaaggtttctctgtctatgtcaacggtgccaattcggagctgaaatcatcaccgcggaaagctattcactctgacttctccagaagtgcctcccacacggaggggacacacgattatggacgaagaactctgtttcgagaagctgaagaagccttaagacgcagttcacggacagcccccagtaaagtccagcgccgaggatggcaccagaaatctgtgcagatcagaacagaagctggcccacggctccacatcgaacctcctgtggactattctgatgattttgagctgtgtggggatgtgactctccaggcaaacaacacttctgaggatcgtccgcaggataccaaatctcccaccagtaccaagccctgtggttttaacttctcccttctgaatgcatgtggacattctgacccttcaagcagcgtggacaaagaaaggatcctcttaactattcaggatgtgatggagctgagaagaagcctggaacttagtgtaaatctacaaaggaaacaaaaggattgttccagcgatgagtatgactctattgaggaagacatactctctgagcctgagccagaggacccggcactggtgggccatcccagacatgaccgccctccttccagtggcgactggactcagaaagatgttcacggggaacaggagacagaaggacgctcttctccaggcccagacaccctcgtggtgctggaatttaacccagcttccaaaagtcataaaagggaaaggaatttgtctgcaaagcggaaggacaatgctgaggttttcgttcccaccaaacctgagccaaacctgactccccaagctcctgctgtattcccagaccaggagaggatgtgctccagacctggaagccggcgagagagacccctgtctgcaacccgcaaaactctttgcgaggctgagtacccagaggaagatgcctctgctgtgctccaagccatccaggtggagaacgcagccctgcagagggcgctcctcagcagaaaggccgagcagccagccagcccactgcaggatgcagaaggaccaccagcaaaaccatggaccagtctgctggaggagaaggaagagacccttgagctgcttcccatcaccacggcgactactactcaggagccggccggggcagcaggaggagccagggccatcaaccaggccatggacagaattgggcttctgggaagcagacaacagcagaagcttctgaaagtcctccaggccgtcgaaagtgactctgcccatctcggcagggtggtttcaccaaccaaggagcaagtatcagacacagaggacaaacagagaatgagggcagacgagatcaaagatgccatctacgtgaccatggagatcctgtccaactggggcaactcgtggtgggtgggtctcacagaagtcgagttctttgacttgaatgacacaaagctttatgtgtcgccccacgatgtggatatccggaacacagccacgcctggggagctgggccgcctcgtcaacaggaacttagctggcaagaaagactcctccccgtggacctgccccttccacccaccactccagctgttttttgttattcgaaacacaagacagctgggggacttccatctggccaagatcaaggttcggaattactggacagctgatggcgatcttgacagttggttgccaagcacgtgaagctatagcgtcttactagttacctc

SEQ ID NO: 355104 - DNA, 866 bp, Homo sapiens
  misc_feature (739)..(739): n is a, c, g, or t
agccggctgtccggtggccgcgctgtggccgccggtggccgttaggctacctgaggccgttccttctggtctctctctcctgggccgcggagagaccgtctccctgccgttacagcaggccccatcccagcgcccagccgtacttggggaaaggccggttgcgattccggggctttcccgccagagctgggtcttctctggggagagctgttttcaccgggaagctcggctttctgtggtaccggcttcatctcccgccttccttgagacccgagtgatatttcttgactacttctgcgtctcacgtaaacatttctccaactctcctactctgtggtatctccctgagatgtgatatcgctagtgccaccatcagaaagaaacgtctggaccctcctgctcaggttatgaaaatccccttaactgccacaatttgcttacctggctcatcgcctcctggactttgtatctttgctaaagtcagtgatgtgaaaagacttgaaatggatgatattgctgataggatgaggatggatgctggagaagtgactttagtgaaccacaactccgtattcaaaacccacctcctgccacaaacaggttttccagaggaccagctttcgctttctgaccagcagattttatcttccaggcaaggacatttggaccgatcttttacatgttccacaagaagtgcagcttataatccaagctattactcagataatctttctccganaggtttctggctcaggcgatttaggaacctggcagagtgcatggcagtggaatttcccatggaggtctttaaaatcagaatgtgaggttactgaacgaaaccggtggataagtgggtagtcacatgt

SEQ ID NO: 355105 - DNA, 864 bp, Homo sapiens
gagcggggaaaccccttcgcatggcagccggttccggttcggactttgtatctttgctaaagtcagtgatgtgaaaagacttgaaatggatgatattgctgataggatgaggatggatgctggagaagtgactttagtgaaccacaactccgtattcaaaacccacctcctgccacaaacaggttttccagaggaccagctttcgctttctgaccagcagattttatcttccaggcaaggacatttggaccgatcttttacatgttccacaagaagtgcagcttataatccaagctattactcagatgacgatttaattcaagatttcttgtggatggactgctgctgtaaaattgcagacaagtatcttttggctatgacctttgtttatttcaagagggctaaatttactataagtgagcataccaggataaatttctttattgctctgtatctggctaatacagttgaagaagatgaagaagaaaccaagtacgaaatttttccatgggctttagggaaaaactggagaaaattgttccctaatttcttaaagttaagggaccagctctgggatagaattgactatagggctattgtaagcaggcgatgttgtgaggaggttatggccattgcaccaagccattatatctggcaaagagaacgttctgttcatcacagtggagctgtcagaaactacaacagagatgaagttcagctgccccggggaccctagttgcacaccagtagactgttcactctgtggtaaaaaaagaagatctgttagactgggattgtcttcatcatcatcttaatccagtcatacagcaggggtgacagaaaaactttcaggactcatacaaa

SEQ ID NO: 355106 - DNA, 429 bp, Homo sapiens
ggttcaagtgattcttctgcctcggctttgcaaagtgctgagattataggcatgagccactgcacctggcttatagtcttgtttaattatatatttttcctagtatatgtttttattttattgttaaaaaagtgacatggccgggcgcggtcgtcacgcctgtaatcccagcattttgggaggccgaggtgggcggatcacctgaggtcaggagttcaagaccagcctggccaacatggtgaaaccccgtctctactaaaaatacaaaaattagccaggtgtgatggcgcgtgcctgtaatcccagctactcaggaggctgaggcaggagaatcacttgaactcaggaggcggaggttgcagtgagcagagattgtgccggtgtactccagcctgggcaacaagagtgagactgtctcaaaaaaaaaaa

SEQ ID NO: 355107 - DNA, 312 bp, Homo sapiens
aacacaggagaaaaaagtcttatttagtttaaagtaaattacataagatattaataacatgcctttgggccataaaatgcagaaatacctttttttttttcctggtcatcaaagcctacccctaaacaaggtagaagttagtgaccctgagaccatcttaccaccctggacctggtccaaatacagacttacacagtggaccattctttcctgagctagccaacaagagcaggagtagtatctggaaactttcccctttgtttaggggtaggctttgatgaccaggaaaaaaaaaaaggtatttctgcattt

SEQ ID NO: 355108 - DNA, 4358 bp, Homo sapiens
  misc_feature (8)..(8): n is a, c, g, or t
agcgggcntggcagccggttccggttcggactttgtatctttgctaaagtcagtgatgtgaaaagacttgaaatggatgatattgctgataggatgaggatggatgctggagaagtgactttagtgaaccacaactccgtattcaaaacccacctcctgccacaaacaggttttccagaggaccagctttcgctttctgaccagcagattttatcttccaggcaaggacatttggaccgatcttttacatgttccacaagaagtgcagcttataatccaagctattactcagataatccttcctcagacagttttcttggctcaggcgatttaagaacctttggccagagtgcaaatggccaatggagaaattctaccccatcgtcaagctcatctttacaaaaatcaagaaacagccgaagtctttacctcgaaacccgaaagacctcaagtggattatcaaacagttttgcgggaaagtcaaaccatcactgccatgtatctgcatatgaaaaatcttttcctattaaacctgttccaagtccatcttggagtggttcatgtcgtcgaagtcttttgagccccaagaaaactcagaggcgacatgttagtacagcagaagagacagttcaagaagaagaaagagagatttacagacagctgctacagatggtcacagggaaacagtttactatagccaaacccaccacacattttcctttacacctgtctcgatgtcttagttccagtaaaaatactttgaaagactcactgtttaaaaatggaaactcttgtgcatctcagatcattggctctgatacttcatcatctggatctgccagcattttaactaaccaggaacagctgtcccacagtgtatattccctatcttcttataccccagatgttgcatttggatccaaagattctggtactcttcatcatccccatcatcaccactctgttccacatcagccagataacttagcagcttcaaatacacaatctgaaggatcagactctgtgattttactgaaagtgaaagattcccagactccaactcccagttctactttcttccaggcagagctgtggatcaaagaattaactagtgtttatgattctcgagcacgagaaagattgcgccagattgaagaacagaaggcattggccttacagcttcaaaaccagagattgcaggagcgggaacattcagtacatgattcagtagaactacatcttcgtgtacctcttgaaaaggagattcctgttactgttgtccaagaaacacaaaaaaaaggtcataaattaactgatagtgaagatgaatttcctgaaattacagaggaaatggagaaagaaataaagaatgtatttcgtaatgggaatcaggatgaagttctcagtgaagcatttcgcctgaccattacacgcaaagatattcaaactctaaaccatctgaattggctcaatgatgagatcatcaatttctacatgaatatgctgatggagcgaagtaaagagaagggcttgccaagtgtgcatgcatttaatacctttttcttcactaaattaaaaacggctggttatcaggcagtgaaacgttggacaaagaaagtagatgtattttctgttgacattcttttggtgcccattcacctgggagtacactggtgtctagctgttgtggactttagaaagaagaatattacctattacgactccatgggtgggataaacaatgaagcctgcagaatactcttgcaatacctaaagcaagaaagcattgacaagaaaaggaaagagtttgacaccaatggctggcagcttttcagcaagaaaagccaggagattcctcagcagatgaatggaagtgactgtgggatgtttgcctgcaaatatgctgactgtattaccaaagacagaccaatcaacttcacacagcaacacatgccatacttccggaagcggatggtctgggagatcctccaccgaaaactcttgtgaagactgtctcacttagcagaccttgaccatgtgggggaccagctctttgttgtctacagccagagaccttggaaacagctgctcccagccctctgctgttgtaacacccttgatcctggaccaggccctggcgagatgcattcacaagcacatctgcctttccttttgtatctcagatactatttttgcaaagaaactttggtgctgtgaaaggggtgagggacatccctaagctgaagagagagactgcttttcacttcttcagttctgccatcttgttttcaaagggctccagcctcactcagtccctaattatgggactgagaaaagcttggaaagaatcttggtttcatataaattcttgttgttaggccttactaagaagtaggaaagggcatgggcaaaaggtagggataaaaaccaccagcatatacatggacatacacacacacccacacacacaaacacacacacacacacaattttcacgatgtatggtcaggaatgtgactgtaaactggactttggggcccaggcataagtcccttcctccaggacctttcctatttatatgtccctatacaaaatccatctgcttttatacgtagctgttttatcatctgtagcttcatcctatccggaggcacagcacatgagccctggacaggtcccaaagttccaagcagtcctttccgtaaaagcaggggtttgcatgtgctaccaacacatgatacggggaagacccacccagggagcggtttcagtggcgcaacaaagcaccacttttactgttgcctacttctgaccaagaagaaaaaggaccttagtatttagcataaaattccagcgctggatgaatgcagatctagtttggtctgtggctagtttaaatatgtttctaaccacagagaatttcatatatatatacatatatatatacacatacatatatatatatatatatgtatgtataaaatttcacagggatatgcttttttttttaaagactgaatgtgttcaccatttagcctgtagatttatttccattttccaaattccagcacacagagatcccagcccctatgagtagggtgtttgtggactacctaatggaatatttttgaggcctggatgaactttgccatatgggtagaggttacagagggaggtgatattttcagctaaaaaaaaaaacgggtggagtttggactgatcaacttgagatttaaaaactgctattccttttgttctttctagcatctctccccaccctctgagagctcctcaggcttagatagtgaagtgatcaaatgccagtgtcattttgtacttaagttccaaagtaggaacattttatacttttttctgtattgtaataggtagttttgtatgaaatcttttctcctctcccgttgtaccgcattctttccagcattgtgctttttccctgggcttatttgaaaattttactgttttatacaagctcgtttagtacatttttctatgttttaccacaagttacaatttgaaaagaaaactattttttttaaatattccattgttaactgaatgttactgtttccactccagcaactacatgtcctcccttcaactgcctgccttttggggaaagaccaccttttgtgtgtttgttttttctctctctttctttccctttctctttctatctctctttatttttctttctttttctttgtttttgagttttctataggaaataaatagctttctatatatgagttgctggggaccttcacattctcttttagaaagctgtggcatgcagtctcattgcaggactcctggaatattgtctggttcttggtatttactgtatgtaagcaacaacttgaaaggtggcaatatggtgtcgatttggactatgaatcaaaagacctttttcaggttctttcactattgtctgggggactcagaacaagattgttctctgtatttattgtttgtccatttaggtaacatctgtcttaccttcctcacagactttgtacagaccaaagcaacaaatatttattgccatgtatagcagaaaatgaaacatgcaacaaaagcactttgaaaaatatataaggaattgttgagcctgtctgaatttgggccccctttctgactaatgcagttttgcacaaggtagaagttagtgaccctgagaccatcttaccaccctggacctggtccaaatacagacttacacagtggaccattctttcctgagctagccaacaagagcaggagtagtatctggaaactttcccctttgtttaggggtaggctttgatgaccaggaaaaaaaaaaaggtatttctgcattt

SEQ ID NO: 355109 - DNA, 4502 bp, Homo sapiens
gagcggggaaaccccttcgcatggcagccggttccggttcggactttgtatctttgctaaagtcagtgatgtgaaaagacttgaaatggatgatattgctgataggatgaggatggatgctggagaagtgactttagtgaaccacaactccgtattcaaaacccacctcctgccacaaacaggttttccagaggaccagctttcgctttctgaccagcagattttatcttccaggcaaggacatttggaccgatcttttacatgttccacaagaagtgcagcttataatccaagctattactcaggcccaggcctgggagtgcttgcaagatatagttggggtaaaatgttgacttttggtggacaccacggagtcacattgatgcagataaggcacatggctgtggcaggattcagctccttcatcaattttcagataatccttcctcagacagttttcttggctcaggcgatttaagaacctttggccagagtgcaaatggccaatggagaaattctaccccatcgtcaagctcatctttacaaaaatcaagaaacagccgaagtctttacctcgaaacccgaaagacctcaagtggattatcaaacagttttgcgggaaagtcaaaccatcactgccatgtatctgcatatgaaaaatcttttcctattaaacctgttccaagtccatcttggagtggttcatgtcgtcgaagtcttttgagccccaagaaaactcagaggcgacatgttagtacagcagaagagacagttcaagaagaagaaagagagatttacagacagctgctacagatggtcacagggaaacagtttactatagccaaacccaccacacattttcctttacacctgtctcgatgtcttagttccagtaaaaatactttgaaagactcactgtttaaaaatggaaactcttgtgcatctcagatcattggctctgatacttcatcatctggatctgccagcattttaactaaccaggaacagctgtcccacagtgtatattccctatcttcttataccccagatgttgcatttggatccaaagattctggtactcttcatcatccccatcatcaccactctgttccacatcagccagataacttagcagcttcaaatacacaatctgaaggatcagactctgtgattttactgaaagtgaaagattcccagactccaactcccagttctactttcttccaggcagagctgtggatcaaagaattaactagtgtttatgattctcgagcacgagaaagattgcgccagattgaagaacagaaggcattggccttacagcttcaaaaccagagattgcaggagcgggaacattcagtacatgattcagtagaactacatcttcgtgtacctcttgaaaaggagattcctgttactgttgtccaagaaacacaaaaaaaaggtcataaattaactgatagtgaagatgaatttcctgaaattacagaggaaatggagaaagaaataaagaatgtatttcgtaatgggaatcaggatgaagttctcagtgaagcatttcgcctgaccattacacgcaaagatattcaaactctaaaccatctgaattggctcaatgatgagatcatcaatttctacatgaatatgctgatggagcgaagtaaagagaagggcttgccaagtgtgcatgcatttaatacctttttcttcactaaattaaaaacggctggttatcaggcagtgaaacgttggacaaagaaagtagatgtattttctgttgacattcttttggtgcccattcacctgggagtacactggtgtctagctgttgtggactttagaaagaagaatattacctattacgactccatgggtgggataaacaatgaagcctgcagaatactcttgcaatacctaaagcaagaaagcattgacaagaaaaggaaagagtttgacaccaatggctggcagcttttcagcaagaaaagccaggagattcctcagcagatgaatggaagtgactgtgggatgtttgcctgcaaatatgctgactgtattaccaaagacagaccaatcaacttcacacagcaacacatgccatacttccggaagcggatggtctgggagatcctccaccgaaaactcttgtgaagactgtctcacttagcagaccttgaccatgtgggggaccagctctttgttgtctacagccagagaccttggaaacagctgctcccagccctctgctgttgtaacacccttgatcctggaccaggccctggcgagatgcattcacaagcacatctgcctttccttttgtatctcagatactatttttgcaaagaaactttggtgctgtgaaaggggtgagggacatccctaagctgaagagagagactgcttttcacttcttcagttctgccatcttgttttcaaagggctccagcctcactcagtccctaattatgggactgagaaaagcttggaaagaatcttggtttcatataaattcttgttgttaggccttactaagaagtaggaaagggcatgggcaaaaggtagggataaaaaccaccagcatatacatggacatacacacacacccacacacacaaacacacacacacacacaattttcacgatgtatggtcaggaatgtgactgtaaactggactttggggcccaggcataagtcccttcctccaggacctttcctatttatatgtccctatacaaaatccatctgcttttatacgtagctgttttatcatctgtagcttcatcctatccggaggcacagcacatgagccctggacaggtcccaaagttccaagcagtcctttccgtaaaagcaggggtttgcatgtgctaccaacacatgatacggggaagacccacccagggagcggtttcagtggcgcaacaaagcaccacttttactgttgcctacttctgaccaagaagaaaaaggaccttagtatttagcataaaattccagcgctggatgaatgcagatctagtttggtctgtggctagtttaaatatgtttctaaccacagagaatttcatatatatatacatatatatatacacatacatatatatatatatatatgtatgtataaaatttcacagggatatgcttttttttttaaagactgaatgtgttcaccatttagcctgtagatttatttccattttccaaattccagcacacagagatcccagcccctatgagtagggtgtttgtggactacctaatggaatatttttgaggcctggatgaactttgccatatgggtagaggttacagagggaggtgatattttcagctaaaaaaaaaaacgggtggagtttggactgatcaacttgagatttaaaaactgctattccttttgttctttctagcatctctccccaccctctgagagctcctcaggcttagatagtgaagtgatcaaatgccagtgtcattttgtacttaagttccaaagtaggaacattttatacttttttctgtattgtaataggtagttttgtatgaaatcttttctcctctcccgttgtaccgcattctttccagcattgtgctttttccctgggcttatttgaaaattttactgttttatacaagctcgtttagtacatttttctatgttttaccacaagttacaatttgaaaagaaaactattttttttaaatattccattgttaactgaatgttactgtttccactccagcaactacatgtcctcccttcaactgcctgccttttggggaaagaccaccttttgtgtgtttgttttttctctctctttctttccctttctctttctatctctctttatttttctttctttttctttgtttttgagttttctataggaaataaatagctttctatatatgagttgctggggaccttcacattctcttttagaaagctgtggcatgcagtctcattgcaggactcctggaatattgtctggttcttggtatttactgtatgtaagcaacaacttgaaaggtggcaatatggtgtcgatttggactatgaatcaaaagacctttttcaggttctttcactattgtctgggggactcagaacaagattgttctctgtatttattgtttgtccatttaggtaacatctgtcttaccttcctcacagactttgtacagaccaaagcaacaaatatttattgccatgtatagcagaaaatgaaacatgcaacaaaagcactttgaaaaatatataaggaattgttgagcctgtctgaatttgggccccctttctgactaatgcagttttgcacaaggtagaagttagtgaccctgagaccatcttaccaccctggacctggtccaaatacagacttacacagtggaccattctttcctgagctagccaacaagagcaggagtagtatctggaaactttcccctttgtttaggggtaggctttgatgaccaggaaaaaaaaaaaggtatttctgcattt

SEQ ID NO: 355110 - DNA, 1882 bp, Homo sapiens
agccggctgtccggtggccgcgctgtggccgccggtggccgttaggctacctgaggccgttccttctggtctctctctcctgggccgcggagagaccgtctccctgccgttacagcaggccccatcccagcgcccagccgtacttggggaaaggccggttgcgattccggggctttcccgccagagctgggtcttctctggggagagctgttttcaccgggaagctcggctttctgtggtaccggcttcatctcccgccttccttgagacccgagtgatatttcttgactacttctgcgtctcacgtaaacatttctccaactctcctactctgtggtatctccctgagatgtgatatcgctagtgccaccatcagaaagaaacgtctggaccctcctgctcaggactttgtatctttgctaaagtcagtgatgtgaaaagacttgaaatggagacaagattttgccttatttcccaggctggtctcgaactcctgggctcaagccattcgtctgcctcagcctcccaaagtgctagtattacagatgatattgctgataggatgaggatggatgctggagaagtgactttagtgaaccacaactccgtattcaaaacccacctcctgccacaaacaggttttccagaggaccagctttcgctttctgaccagcagattttatcttccaggcaaggacatttggaccgatcttttacatgttccacaagaagtgcagcttataatccaagctattactcaggcccaggcctgggagtgcttgcaagatatagttggggtaaaatgttgacttttggtggacaccacggagtcacattgatgcagataaggcacatggctgtggcaggattcagctccttcatcaattttcagataatccttcctcagacagttttcttggctcaggcgatttaagaacctttggccagagtgcaaatggccaatggagaaattctaccccatcgtcaagctcatctttacaaaaatcaagaaacagccgaagtctttacctcgaaacccgaaagacctcaagtggattatcaaacagttttgcgggaaagtcaaaccatcactgccatgtatctgcatatgaaaaatcttttcctattaaacctgttccaagtccatcttggagtggttcatgtcgtcgaagtcttttgagccccaagaaaactcagaggcgacatgttagtacagcagaagaggaatatgaagtcttctacaaaattaacaattaagatgatgtcaccactgcactgctcagtcttacaacagaggtttgaagagaacacatgaagaagaatttagaaatatgcaagtagtggctgtgcagaatggctgatgctcaagaggcaacatcaaaaagctgtgctattcagtagggtaacggctagccacaagcactgtttaaattaattcaaattcaaattgaaaatttagttactcagtgacactagccacattttaagtattcattagccacatgtggctagtggctaccatattggacagggcaaatatagaacatttctattactacagaaatttctgttagataatgctgttatagaggatataaagttctgtttggaaaagagaaaatacttgtgacaataaaaatgtaaaatggcaaaaacacaggtagtttcttttcagttacatgttgcttctagacacgcttctttgcaaattattgagcaacattttaagatactggacccccctctcccgtaccaaagcccgttgtaaacctttaccagggcccccttttttttttagcccccgtcaagcatagcggtttccccaatcttttgaaaagggcgaccttcaaattcaatttggccccgggttaaaaactttgcc

SEQ ID NO: 355111 - DNA, 1658 bp, Homo sapiens
agccggctgtccggtggccgcgctgtggccgccggtggccgttaggctacctgaggccgttccttctggtctctctctcctgggccgcggagagaccgtctccctgccgttacagcaggccccatcccagcgcccagccgtacttggggaaaggccggttgcgattccggggctttcccgccagagctgggtcttctctggggagagctgttttcaccgggaagctcggctttctgtggtaccggcttcatctcccgccttccttgagacccgagtgatatttcttgactacttctgcgtctcacgtaaacatttctccaactctcctactctgtggtatctccctgagatgtgatatcgctagtgccaccatcagaaagaaacgtctggaccctcctgctcaggactttgtatctttgctaaagtcagtgatgtgaaaagacttgaaatggatgatattgctgataggatgaggatggatgctggagaagtgactttagtgaaccacaactccgtattcaaaacccacctcctgccacaaacaggttttccagaggaccagctttcgctttctgaccagcagattttatcttccaggcaaggacatttggaccgatcttttacatgttccacaagaagtgcagcttataatccaagctattactcagataatccttcctcagacagttttcttggctcaggcgatttaagaacctttggccagagtgcaaatggccaatggagaaattctaccccatcgtcaagctcatctttacaaaaatcaagaaacagccgaagtctttacctcgaaacccgaaagacctcaagtggattatcaaacagttttgcgggaaagtcaaaccatcactgccatgtatctgcatatgaaaaatcttttcctattaaacctgttccaagtccatcttggagtggttcatgtcgtcgaagtcttttgagccccaagaaaactcagaggcgacatgttagtacagcagaagaggaatatgaagtcttctacaaaattaacaattaagatgatgtcaccactgcactgctcagtcttacaacagaggtttgaagagaacacatgaagaagaatttagaaatatgcaagtagtggctgtgcagaatggctgatgctcaagaggcaacatcaaaaagctgtgctattcagtagggtaacggctagccacaagcactgtttaaattaattcaaattcaaattgaaaatttagttactcagtgacactagccacattttaagtattcattagccacatgtggctagtggctaccatattggacagggcaaatatagaacatttctattactacagaaatttctgttagataatgctgttatagaggatataaagttctgtttggaaaagagaaaatacttgtgacaataaaaatgtaaaatggcaaaaacacaggtagtttcttttcagttacatgttgcttctagacacgcttctttgcaaattattgagcaacattttaagatactggacccccctctcccgtaccaaagcccgttgtaaacctttaccagggcccccttttttttttagcccccgtcaagcatagcggtttccccaatcttttgaaaagggcgaccttcaaattcaatttggccccgggttaaaaactttgcc

SEQ ID NO: 355112 - DNA, 2195 bp, Homo sapiens
agccggctgtccggtggccgcgctgtggccgccggtggccgttaggctacctgaggccgttccttctggtctctctctcctgggccgcggagagaccgtctccctgccgttacagcaggccccatcccagcgcccagccgtacttggggaaaggccggttgcgattccggggctttcccgccagagctgggtcttctctggggagagctgttttcaccgggaagctcggctttctgtggtaccggcttcatctcccgccttccttgagacccgagtgatatttcttgactacttctgcgtctcacgtaaacatttctccaactctcctactctgtggtatctccctgagatgtgatatcgctagtgccaccatcagaaagaaacgtctggaccctcctgctcaggactttgtatctttgctaaagtcagtgatgtgaaaagacttgaaatggatgatattgctgataggatgaggatggatgctggagaagtgactttagtgaaccacaactccgtattcaaaacccacctcctgccacaaacaggttttccagaggaccagctttcgctttctgaccagcagattttatcttccaggcaaggacatttggaccgatcttttacatgttccacaagaagtgcagcttataatccaagctattactcagataatccttcctcagacagttttcttggctcaggcgatttaagaacctttggccagagtgcaaatggccaatggagaaattctaccccatcgtcaagctcatctttacaaaaatcaagaaacagccgaagtctttacctcgaaacccgaaagacctcaagtggattatcaaacagttttgcgggaaagtcaaaccatcactgccatgtatctgcatatgaaaaatcttttcctattaaacctgttccaagtccatcttggagtggttcatgtcgtcgaagtcttttgagccccaagaaaactcagaggcgacatgttagtacagcagaagagacagttcaagaagaagaaagagagatttacagacagctgctacagatggtcacagggaaacagtttactatagccaaacccaccacacattttcctttacacctgtctcgatgtcttagttccagtaaaaatactttgaaagactcactgtttaaaaatggaaactcttgtgcatctcagatcattggctctgatacttcatcatctggatctgccagcattttaactaaccaggaacagctgtcccacagtgtatattccctatcttcttataccccagatgttgcatttggatccaaagattctggtactcttcatcatccccatcatcaccactctgttccacatcagccagataacttagcagcttcaaatacacaatctgaaggatcagactctgtgattttactgaaagtgaaagattcccagactccaactcccagttctactttcttccaggcagagctgtggatcaaagaattaactagtgtttatgattctcgagcacgagaaagattgcgccagattgaagaacagaaggcattggccttacagcttcaaaaccagagattgcaggagcgggaacattcagtacatgattcagtagaactacatcttcgtgtacctcttgaaaaggagattcctgttactgttgtccaagaaacacaaaaaaaaggtcataaattaactgatagtgaagatgaatttcctgaaattacagaggaaatggagaaagaaataaagaatgtatttcgtaatgggaatcaggatgaagttctcagtgaagcatttcgcctgaccattacacgcaaagatattcaaactctaaaccatctgaattggctcaatgatgaggtaatgttgcatctatttttacatacaaatagtaaacattaagtggcagttaaattaaggcattatctcactttttctcttcttgtaactatgagggagtgtggtggagacaggcatttttaacaaacatctcaggtgtattttaaagtctgagaaccactgaatttaccttttcttgttgaagatttgaacattgaagaagacattcactcattggtattctcactctttaaggctcctattctgcagttcatctcttctgaacaaataagtattagccgaccatgttgcagcatgagggaatactgtgggatttctttataggaatccagttttactt

SEQ ID NO: 355113 - DNA, 971 bp, Homo sapiens
gagagagagagagagagagagagagagagagagagagagagagactttccagcattgtgctttttccctgggcttatttgaaaattttactgttttatacaagctcgtttagtacatttttctatgttttaccacaagttacaatttgaaaagaaaactattttttttaaatattccattgttaactgaatgttactgtttccactccagcaactacatgtcctcccttcaactgcctgccttttggggaaagaccaccttttgtgtgtttgttttttctctctctttctttccctttctctttctatctctctttatttttctttctttttctttgtttttgagttttctataggaaataaatagctttctatatatgagttgctggggaccttcacattctcttttagaaagctgtggcatgcagtctcattgcaggactcctggaatattgtctggttcttggtatttactgtatgtaagcaacaacttgaaaggtggcaatatggtgtcgatttggactatgaatcaaaagacctttttcaggttctttcactattgtctgggggactcagaacaagattgttctctgtatttattgtttgtccatttaggtaacatctgtcttaccttcctcacagactttgtacagaccaaagcaacaaatatttattgccatgtatagcagaaaatgaaacatgcaacaaaagcactttgaaaaatatataaggaattgttgagcctgtctgaatttgggccccctttctgactaatgcagttttgcacaaggtagaagttagtgaccctgagaccatcttaccaccctggacctggtccaaatacagacttacacagtggaccattctttcctgagctagccaacaagagcaggagtagtatctggaaactttcccctttgtttaggggtaggctttgatgaccaggaaaaaaaaaaaggtatttctgcattt

SEQ ID NO: 355114 - DNA, 456 bp, Homo sapiens
taaattaattcaaattcaaattgaaaatttagttactcagtgacactagccacattttaagtattcattagccacatgtggctagtggctaccatattggacagggcaaatatagaacatttctattactacagaaatttctgttagataatgctgttatagaggatataaagttctgtttggaaaagagaaaatacttgtgacaataaaaatgtaaaatggcaaaaacacaggtagtttcttttcagttacatgttgcttctagacacgcttctttgcaaattattgagcaacattttaagatactggacttttgtaataggtgacagtgatggttttatacttttcttagaactgctttacagtgttgtcataagtcaagcatttgggactcagaaaattattgaaatttgcactttgcatattttatatggtataaagttattactttaaaca

SEQ ID NO: 355115 - DNA, 440 bp, Homo sapiens
gaggttgcagtgagcagagattgtgccggtgtactccagcctgggcaacaagagtgagactgtctcaaaaaaaaaaaaaatgtgacttaagaaaaatcttctgctttgtttagattttatcttccaggcaaggacatttggaccgatcttttacatgttccacaagaagtgcagcttataatccaagctattactcaggtatgacacattacttggagtcaagggactttataccttttggatttcttgatagcatatcgtttatgtttatcatctccaaaagtaaaaacattgtcaaaaacaagatggtattttcttcactaaaacatcatttgaatggcttttcctgtgtatgtggttgctatgatactttactgattttgtctcatccaaatactggttttctagtgggaaagtgttttgagaatctaactgtccat

SEQ ID NO: 355116 - DNA, 4734 bp, Homo sapiens
agccggctgtccggtggccgcgctgtggccgccggtggccgttaggctacctgaggccgttccttctggtctctctctcctgggccgcggagagaccgtctccctgccgttacagcaggccccatcccagcgcccagccgtacttggggaaaggccggttgcgattccggggctttcccgccagagctgggtcttctctggggagagctgttttcaccgggaagctcggctttctgtggtaccggcttcatctcccgccttccttgagacccgagtgatatttcttgactacttctgcgtctcacgtaaacatttctccaactctcctactctgtggtatctccctgagatgtgatatcgctagtgccaccatcagaaagaaacgtctggaccctcctgctcaggactttgtatctttgctaaagtcagtgatgtgaaaagacttgaaatggatgatattgctgataggatgaggatggatgctggagaagtgactttagtgaaccacaactccgtattcaaaacccacctcctgccacaaacaggttttccagaggaccagctttcgctttctgaccagcagattttatcttccaggcaaggacatttggaccgatcttttacatgttccacaagaagtgcagcttataatccaagctattactcagataatccttcctcagacagttttcttggctcaggcgatttaagaacctttggccagagtgcaaatggccaatggagaaattctaccccatcgtcaagctcatctttacaaaaatcaagaaacagccgaagtctttacctcgaaacccgaaagacctcaagtggattatcaaacagttttgcgggaaagtcaaaccatcactgccatgtatctgcatatgaaaaatcttttcctattaaacctgttccaagtccatcttggagtggttcatgtcgtcgaagtcttttgagccccaagaaaactcagaggcgacatgttagtacagcagaagagacagttcaagaagaagaaagagagatttacagacagctgctacagatggtcacagggaaacagtttactatagccaaacccaccacacattttcctttacacctgtctcgatgtcttagttccagtaaaaatactttgaaagactcactgtttaaaaatggaaactcttgtgcatctcagatcattggctctgatacttcatcatctggatctgccagcattttaactaaccaggaacagctgtcccacagtgtatattccctatcttcttataccccagatgttgcatttggatccaaagattctggtactcttcatcatccccatcatcaccactctgttccacatcagccagataacttagcagcttcaaatacacaatctgaaggatcagactctgtgattttactgaaagtgaaagattcccagactccaactcccagttctactttcttccaggcagagctgtggatcaaagaattaactagtgtttatgattctcgagcacgagaaagattgcgccagattgaagaacagaaggcattggccttacagcttcaaaaccagagattgcaggagcgggaacattcagtacatgattcagtagaactacatcttcgtgtacctcttgaaaaggagattcctgttactgttgtccaagaaacacaaaaaaaaggtcataaattaactgatagtgaagatgaatttcctgaaattacagaggaaatggagaaagaaataaagaatgtatttcgtaatgggaatcaggatgaagttctcagtgaagcatttcgcctgaccattacacgcaaagatattcaaactctaaaccatctgaattggctcaatgatgagatcatcaatttctacatgaatatgctgatggagcgaagtaaagagaagggcttgccaagtgtgcatgcatttaatacctttttcttcactaaattaaaaacggctggttatcaggcagtgaaacgttggacaaagaaagtagatgtattttctgttgacattcttttggtgcccattcacctgggagtacactggtgtctagctgttgtggactttagaaagaagaatattacctattacgactccatgggtgggataaacaatgaagcctgcagaatactcttgcaatacctaaagcaagaaagcattgacaagaaaaggaaagagtttgacaccaatggctggcagcttttcagcaagaaaagccaggagattcctcagcagatgaatggaagtgactgtgggatgtttgcctgcaaatatgctgactgtattaccaaagacagaccaatcaacttcacacagcaacacatgccatacttccggaagcggatggtctgggagatcctccaccgaaaactcttgtgaagactgtctcacttagcagaccttgaccatgtgggggaccagctctttgttgtctacagccagagaccttggaaacagctgctcccagccctctgctgttgtaacacccttgatcctggaccaggccctggcgagatgcattcacaagcacatctgcctttccttttgtatctcagatactatttttgcaaagaaactttggtgctgtgaaaggggtgagggacatccctaagctgaagagagagactgcttttcacttcttcagttctgccatcttgttttcaaagggctccagcctcactcagtccctaattatgggactgagaaaagcttggaaagaatcttggtttcatataaattcttgttgttaggccttactaagaagtaggaaagggcatgggcaaaaggtagggataaaaaccaccagcatatacatggacatacacacacacccacacacacaaacacacacacacacacaattttcacgatgtatggtcaggaatgtgactgtaaactggactttggggcccaggcataagtcccttcctccaggacctttcctatttatatgtccctatacaaaatccatctgcttttatacgtagctgttttatcatctgtagcttcatcctatccggaggcacagcacatgagccctggacaggtcccaaagttccaagcagtcctttccgtaaaagcaggggtttgcatgtgctaccaacacatgatacggggaagacccacccagggagcggtttcagtggcgcaacaaagcaccacttttactgttgcctacttctgaccaagaagaaaaaggaccttagtatttagcataaaattccagcgctggatgaatgcagatctagtttggtctgtggctagtttaaatatgtttctaaccacagagaatttcatatatatatacatatatatatacacatacatatatatatatatatatgtatgtataaaatttcacagggatatgcttttttttttaaagactgaatgtgttcaccatttagcctgtagatttatttccattttccaaattccagcacacagagatcccagcccctatgagtagggtgtttgtggactacctaatggaatatttttgaggcctggatgaactttgccatatgggtagaggttacagagggaggtgatattttcagctaaaaaaaaaaacgggtggagtttggactgatcaacttgagatttaaaaactgctattccttttgttctttctagcatctctccccaccctctgagagctcctcaggcttagatagtgaagtgatcaaatgccagtgtcattttgtacttaagttccaaagtaggaacattttatacttttttctgtattgtaataggtagttttgtatgaaatcttttctcctctcccgttgtaccgcattctttccagcattgtgctttttccctgggcttatttgaaaattttactgttttatacaagctcgtttagtacatttttctatgttttaccacaagttacaatttgaaaagaaaactattttttttaaatattccattgttaactgaatgttactgtttccactccagcaactacatgtcctcccttcaactgcctgccttttggggaaagaccaccttttgtgtgtttgttttttctctctctttctttccctttctctttctatctctctttatttttctttctttttctttgtttttgagttttctataggaaataaatagctttctatatatgagttgctggggaccttcacattctcttttagaaagctgtggcatgcagtctcattgcaggactcctggaatattgtctggttcttggtatttactgtatgtaagcaacaacttgaaaggtggcaatatggtgtcgatttggactatgaatcaaaagacctttttcaggttctttcactattgtctgggggactcagaacaagattgttctctgtatttattgtttgtccatttaggtaacatctgtcttaccttcctcacagactttgtacagaccaaagcaacaaatatttattgccatgtatagcagaaaatgaaacatgcaacaaaagcactttgaaaaatatataaggaattgttgagcctgtctgaatttgggccccctttctgactaatgcagttttgcacaaggtagaagttagtgaccctgagaccatcttaccaccctggacctggtccaaatacagacttacacagtggaccattctttcctgagctagccaacaagagcaggagtagtatctggaaactttcccctttgtttaggggtaggctttgatgaccaggaaaaaaaaaaaggtatttctgcattt

SEQ ID NO: 355117 - DNA, 4958 bp, Homo sapiens
agccggctgtccggtggccgcgctgtggccgccggtggccgttaggctacctgaggccgttccttctggtctctctctcctgggccgcggagagaccgtctccctgccgttacagcaggccccatcccagcgcccagccgtacttggggaaaggccggttgcgattccggggctttcccgccagagctgggtcttctctggggagagctgttttcaccgggaagctcggctttctgtggtaccggcttcatctcccgccttccttgagacccgagtgatatttcttgactacttctgcgtctcacgtaaacatttctccaactctcctactctgtggtatctccctgagatgtgatatcgctagtgccaccatcagaaagaaacgtctggaccctcctgctcaggactttgtatctttgctaaagtcagtgatgtgaaaagacttgaaatggagacaagattttgccttatttcccaggctggtctcgaactcctgggctcaagccattcgtctgcctcagcctcccaaagtgctagtattacagatgatattgctgataggatgaggatggatgctggagaagtgactttagtgaaccacaactccgtattcaaaacccacctcctgccacaaacaggttttccagaggaccagctttcgctttctgaccagcagattttatcttccaggcaaggacatttggaccgatcttttacatgttccacaagaagtgcagcttataatccaagctattactcaggcccaggcctgggagtgcttgcaagatatagttggggtaaaatgttgacttttggtggacaccacggagtcacattgatgcagataaggcacatggctgtggcaggattcagctccttcatcaattttcagataatccttcctcagacagttttcttggctcaggcgatttaagaacctttggccagagtgcaaatggccaatggagaaattctaccccatcgtcaagctcatctttacaaaaatcaagaaacagccgaagtctttacctcgaaacccgaaagacctcaagtggattatcaaacagttttgcgggaaagtcaaaccatcactgccatgtatctgcatatgaaaaatcttttcctattaaacctgttccaagtccatcttggagtggttcatgtcgtcgaagtcttttgagccccaagaaaactcagaggcgacatgttagtacagcagaagagacagttcaagaagaagaaagagagatttacagacagctgctacagatggtcacagggaaacagtttactatagccaaacccaccacacattttcctttacacctgtctcgatgtcttagttccagtaaaaatactttgaaagactcactgtttaaaaatggaaactcttgtgcatctcagatcattggctctgatacttcatcatctggatctgccagcattttaactaaccaggaacagctgtcccacagtgtatattccctatcttcttataccccagatgttgcatttggatccaaagattctggtactcttcatcatccccatcatcaccactctgttccacatcagccagataacttagcagcttcaaatacacaatctgaaggatcagactctgtgattttactgaaagtgaaagattcccagactccaactcccagttctactttcttccaggcagagctgtggatcaaagaattaactagtgtttatgattctcgagcacgagaaagattgcgccagattgaagaacagaaggcattggccttacagcttcaaaaccagagattgcaggagcgggaacattcagtacatgattcagtagaactacatcttcgtgtacctcttgaaaaggagattcctgttactgttgtccaagaaacacaaaaaaaaggtcataaattaactgatagtgaagatgaatttcctgaaattacagaggaaatggagaaagaaataaagaatgtatttcgtaatgggaatcaggatgaagttctcagtgaagcatttcgcctgaccattacacgcaaagatattcaaactctaaaccatctgaattggctcaatgatgagatcatcaatttctacatgaatatgctgatggagcgaagtaaagagaagggcttgccaagtgtgcatgcatttaatacctttttcttcactaaattaaaaacggctggttatcaggcagtgaaacgttggacaaagaaagtagatgtattttctgttgacattcttttggtgcccattcacctgggagtacactggtgtctagctgttgtggactttagaaagaagaatattacctattacgactccatgggtgggataaacaatgaagcctgcagaatactcttgcaatacctaaagcaagaaagcattgacaagaaaaggaaagagtttgacaccaatggctggcagcttttcagcaagaaaagccaggagattcctcagcagatgaatggaagtgactgtgggatgtttgcctgcaaatatgctgactgtattaccaaagacagaccaatcaacttcacacagcaacacatgccatacttccggaagcggatggtctgggagatcctccaccgaaaactcttgtgaagactgtctcacttagcagaccttgaccatgtgggggaccagctctttgttgtctacagccagagaccttggaaacagctgctcccagccctctgctgttgtaacacccttgatcctggaccaggccctggcgagatgcattcacaagcacatctgcctttccttttgtatctcagatactatttttgcaaagaaactttggtgctgtgaaaggggtgagggacatccctaagctgaagagagagactgcttttcacttcttcagttctgccatcttgttttcaaagggctccagcctcactcagtccctaattatgggactgagaaaagcttggaaagaatcttggtttcatataaattcttgttgttaggccttactaagaagtaggaaagggcatgggcaaaaggtagggataaaaaccaccagcatatacatggacatacacacacacccacacacacaaacacacacacacacacaattttcacgatgtatggtcaggaatgtgactgtaaactggactttggggcccaggcataagtcccttcctccaggacctttcctatttatatgtccctatacaaaatccatctgcttttatacgtagctgttttatcatctgtagcttcatcctatccggaggcacagcacatgagccctggacaggtcccaaagttccaagcagtcctttccgtaaaagcaggggtttgcatgtgctaccaacacatgatacggggaagacccacccagggagcggtttcagtggcgcaacaaagcaccacttttactgttgcctacttctgaccaagaagaaaaaggaccttagtatttagcataaaattccagcgctggatgaatgcagatctagtttggtctgtggctagtttaaatatgtttctaaccacagagaatttcatatatatatacatatatatatacacatacatatatatatatatatatgtatgtataaaatttcacagggatatgcttttttttttaaagactgaatgtgttcaccatttagcctgtagatttatttccattttccaaattccagcacacagagatcccagcccctatgagtagggtgtttgtggactacctaatggaatatttttgaggcctggatgaactttgccatatgggtagaggttacagagggaggtgatattttcagctaaaaaaaaaaacgggtggagtttggactgatcaacttgagatttaaaaactgctattccttttgttctttctagcatctctccccaccctctgagagctcctcaggcttagatagtgaagtgatcaaatgccagtgtcattttgtacttaagttccaaagtaggaacattttatacttttttctgtattgtaataggtagttttgtatgaaatcttttctcctctcccgttgtaccgcattctttccagcattgtgctttttccctgggcttatttgaaaattttactgttttatacaagctcgtttagtacatttttctatgttttaccacaagttacaatttgaaaagaaaactattttttttaaatattccattgttaactgaatgttactgtttccactccagcaactacatgtcctcccttcaactgcctgccttttggggaaagaccaccttttgtgtgtttgttttttctctctctttctttccctttctctttctatctctctttatttttctttctttttctttgtttttgagttttctataggaaataaatagctttctatatatgagttgctggggaccttcacattctcttttagaaagctgtggcatgcagtctcattgcaggactcctggaatattgtctggttcttggtatttactgtatgtaagcaacaacttgaaaggtggcaatatggtgtcgatttggactatgaatcaaaagacctttttcaggttctttcactattgtctgggggactcagaacaagattgttctctgtatttattgtttgtccatttaggtaacatctgtcttaccttcctcacagactttgtacagaccaaagcaacaaatatttattgccatgtatagcagaaaatgaaacatgcaacaaaagcactttgaaaaatatataaggaattgttgagcctgtctgaatttgggccccctttctgactaatgcagttttgcacaaggtagaagttagtgaccctgagaccatcttaccaccctggacctggtccaaatacagacttacacagtggaccattctttcctgagctagccaacaagagcaggagtagtatctggaaactttcccctttgtttaggggtaggctttgatgaccaggaaaaaaaaaaaggtatttctgcattt

SEQ ID NO: 355118 - DNA, 4191 bp, Homo sapiens
  misc_feature (25)..(25): n is a, c, g, or t
gcctagcggcaacgactctcttaantttccaccgctacacattttatcttccaggcaaggacatttggaccgatcttttacatgttccacaagaagtgcagcttataatccaagctattactcagataatccttcctcagacagttttcttggctcaggcgatttaagaacctttggccagagtgcaaatggccaatggagaaattctaccccatcgtcaagctcatctttacaaaaatcaagaaacagccgaagtctttacctcgaaacccgaaagacctcaagtggattatcaaacagttttgcgggaaagtcaaaccatcactgccatgtatctgcatatgaaaaatcttttcctattaaacctgttccaagtccatcttggagtggttcatgtcgtcgaagtcttttgagccccaagaaaactcagaggcgacatgttagtacagcagaagagacagttcaagaagaagaaagagagatttacagacagctgctacagatggtcacagggaaacagtttactatagccaaacccaccacacattttcctttacacctgtctcgatgtcttagttccagtaaaaatactttgaaagactcactgtttaaaaatggaaactcttgtgcatctcagatcattggctctgatacttcatcatctggatctgccagcattttaactaaccaggaacagctgtcccacagtgtatattccctatcttcttataccccagatgttgcatttggatccaaagattctggtactcttcatcatccccatcatcaccactctgttccacatcagccagataacttagcagcttcaaatacacaatctgaaggatcagactctgtgattttactgaaagtgaaagattcccagactccaactcccagttctactttcttccaggcagagctgtggatcaaagaattaactagtgtttatgattctcgagcacgagaaagattgcgccagattgaagaacagaaggcattggccttacagcttcaaaaccagagattgcaggagcgggaacattcagtacatgattcagtagaactacatcttcgtgtacctcttgaaaaggagattcctgttactgttgtccaagaaacacaaaaaaaaggtcataaattaactgatagtgaagatgaatttcctgaaattacagaggaaatggagaaagaaataaagaatgtatttcgtaatgggaatcaggatgaagttctcagtgaagcatttcgcctgaccattacacgcaaagatattcaaactctaaaccatctgaattggctcaatgatgagatcatcaatttctacatgaatatgctgatggagcgaagtaaagagaagggcttgccaagtgtgcatgcatttaatacctttttcttcactaaattaaaaacggctggttatcaggcagtgaaacgttggacaaagaaagtagatgtattttctgttgacattcttttggtgcccattcacctgggagtacactggtgtctagctgttgtggactttagaaagaagaatattacctattacgactccatgggtgggataaacaatgaagcctgcagaatactcttgcaatacctaaagcaagaaagcattgacaagaaaaggaaagagtttgacaccaatggctggcagcttttcagcaagaaaagccaggagattcctcagcagatgaatggaagtgactgtgggatgtttgcctgcaaatatgctgactgtattaccaaagacagaccaatcaacttcacacagcaacacatgccatacttccggaagcggatggtctgggagatcctccaccgaaaactcttgtgaagactgtctcacttagcagaccttgaccatgtgggggaccagctctttgttgtctacagccagagaccttggaaacagctgctcccagccctctgctgttgtaacacccttgatcctggaccaggccctggcgagatgcattcacaagcacatctgcctttccttttgtatctcagatactatttttgcaaagaaactttggtgctgtgaaaggggtgagggacatccctaagctgaagagagagactgcttttcacttcttcagttctgccatcttgttttcaaagggctccagcctcactcagtccctaattatgggactgagaaaagcttggaaagaatcttggtttcatataaattcttgttgttaggccttactaagaagtaggaaagggcatgggcaaaaggtagggataaaaaccaccagcatatacatggacatacacacacacccacacacacaaacacacacacacacacaattttcacgatgtatggtcaggaatgtgactgtaaactggactttggggcccaggcataagtcccttcctccaggacctttcctatttatatgtccctatacaaaatccatctgcttttatacgtagctgttttatcatctgtagcttcatcctatccggaggcacagcacatgagccctggacaggtcccaaagttccaagcagtcctttccgtaaaagcaggggtttgcatgtgctaccaacacatgatacggggaagacccacccagggagcggtttcagtggcgcaacaaagcaccacttttactgttgcctacttctgaccaagaagaaaaaggaccttagtatttagcataaaattccagcgctggatgaatgcagatctagtttggtctgtggctagtttaaatatgtttctaaccacagagaatttcatatatatatacatatatatatacacatacatatatatatatatatatgtatgtataaaatttcacagggatatgcttttttttttaaagactgaatgtgttcaccatttagcctgtagatttatttccattttccaaattccagcacacagagatcccagcccctatgagtagggtgtttgtggactacctaatggaatatttttgaggcctggatgaactttgccatatgggtagaggttacagagggaggtgatattttcagctaaaaaaaaaaacgggtggagtttggactgatcaacttgagatttaaaaactgctattccttttgttctttctagcatctctccccaccctctgagagctcctcaggcttagatagtgaagtgatcaaatgccagtgtcattttgtacttaagttccaaagtaggaacattttatacttttttctgtattgtaataggtagttttgtatgaaatcttttctcctctcccgttgtaccgcattctttccagcattgtgctttttccctgggcttatttgaaaattttactgttttatacaagctcgtttagtacatttttctatgttttaccacaagttacaatttgaaaagaaaactattttttttaaatattccattgttaactgaatgttactgtttccactccagcaactacatgtcctcccttcaactgcctgccttttggggaaagaccaccttttgtgtgtttgttttttctctctctttctttccctttctctttctatctctctttatttttctttctttttctttgtttttgagttttctataggaaataaatagctttctatatatgagttgctggggaccttcacattctcttttagaaagctgtggcatgcagtctcattgcaggactcctggaatattgtctggttcttggtatttactgtatgtaagcaacaacttgaaaggtggcaatatggtgtcgatttggactatgaatcaaaagacctttttcaggttctttcactattgtctgggggactcagaacaagattgttctctgtatttattgtttgtccatttaggtaacatctgtcttaccttcctcacagactttgtacagaccaaagcaacaaatatttattgccatgtatagcagaaaatgaaacatgcaacaaaagcactttgaaaaatatataaggaattgttgagcctgtctgaatttgggccccctttctgactaatgcagttttgcacaaggtagaagttagtgaccctgagaccatcttaccaccctggacctggtccaaatacagacttacacagtggaccattctttcctgagctagccaacaagagcaggagtagtatctggaaactttcccctttgtttaggggtaggctttgatgaccaggaaaaaaaaaaaggtatttctgcattt

SEQ ID NO: 355119 - DNA, 1115 bp, Homo sapiens
  misc_feature (25)..(25): n is a, c, g, or t
gcctagcggcaacgactctcttaantttccaccgctacacattttatcttccaggcaaggacatttggaccgatcttttacatgttccacaagaagtgcagcttataatccaagctattactcagataatccttcctcagacagttttcttggctcaggcgatttaagaacctttggccagagtgcaaatggccaatggagaaattctaccccatcgtcaagctcatctttacaaaaatcaagaaacagccgaagtctttacctcgaaacccgaaagacctcaagtggattatcaaacagttttgcgggaaagtcaaaccatcactgccatgtatctgcatatgaaaaatcttttcctattaaacctgttccaagtccatcttggagtggttcatgtcgtcgaagtcttttgagccccaagaaaactcagaggcgacatgttagtacagcagaagaggaatatgaagtcttctacaaaattaacaattaagatgatgtcaccactgcactgctcagtcttacaacagaggtttgaagagaacacatgaagaagaatttagaaatatgcaagtagtggctgtgcagaatggctgatgctcaagaggcaacatcaaaaagctgtgctattcagtagggtaacggctagccacaagcactgtttaaattaattcaaattcaaattgaaaatttagttactcagtgacactagccacattttaagtattcattagccacatgtggctagtggctaccatattggacagggcaaatatagaacatttctattactacagaaatttctgttagataatgctgttatagaggatataaagttctgtttggaaaagagaaaatacttgtgacaataaaaatgtaaaatggcaaaaacacaggtagtttcttttcagttacatgttgcttctagacacgcttctttgcaaattattgagcaacattttaagatactggacccccctctcccgtaccaaagcccgttgtaaacctttaccagggcccccttttttttttagcccccgtcaagcatagcggtttccccaatcttttgaaaagggcgaccttcaaattcaatttggccccgggttaaaaactttgcc

SEQ ID NO: 355120 - DNA, 374 bp, Homo sapiens
aaacaaataatatgtggctgagactttatgtggcctgcaaagcctaaaatatttgctgtctgactcttgatagaaaatgtttgccaacccagacttagtttattagctcttcaacctaacaaaacagcttagtttctgaaacaatttactgtgactttttttagtttggcttcatatcccttatgtttggcttggtaatcattttatgagttggataagattcatagtttttttaaatgatgaggcatcaggcaaacagtgttatgagtagccagggaaaaaatggaaatcgacacaattagatgctttaaaatgcataatcacatctatcacttcatgggcctgtaaaaaataaatcacatattctaaagatg

SEQ ID NO: 355121 - DNA, 2185 bp, Homo sapiens
gaattccttttttttgaatttctctctttaattaaggtctaccccaagccacggaaagaggagtagaccatgattactgtgaacccccccttaccccaggacactgtgaatctcttctcgcctgtgcccccacccgacaaggtggacggcttctcccgccgttccctccgcagagcccggccccgccgctcccacagctcctctcagttccgctatcagagcaaccagcaagagctcacaccgctgcccctgctcaaagatgtgccggcttccgagctgcacgagctgctgagccggaagctggcccagtgtggggtgatgtttgacttcttggactgtgtggccgacctcaaggggaaggaggtgaagcgggcagccctcaacgagctggtggagtgtgtggggagcacccggggtgtcctcatcgagcccgtctacccagacatcatccgcatgatctcagtgaatatcttccggactctgccgcccagtgagaaccctgaatttgaccctgaagaggatgagcccaatcttgagccttcgtggccacacctgcagctggtatatgagtttttcctgcgtttcttggagagcccagacttccagccctccgtggccaagagatatgtggatcaaaagtttgtcctgatgctcctggagctatttgatagtgaggatccccgggagcgtgagtacctcaagaccatcctgcaccgggtctatggcaagttcctgggtctccgggcctacatccgcaaacagtgcaaccacatcttcctccggttcatctatgaattcgagcacttcaatggtgtggctgagctgctggagatcctaggaagcatcatcaatggctttgcgctgcccctgaagacggagcacaagcagttcctggttcgcgtcctgatccccctgcactctgtcaagtcgctgtctgtcttccatgcccagctggcatactgtgtggtgcagttcctggagaaggatgccactctgacagagcacgtgatccgggggctgctcaaatactggccaaaaacctgcacccagaaggaggtgatgtttctgggggagatggaagagattcttgatgtcatcgagccctcccagtttgtgaagatccaggagcccctttttaagcaggtggctcgctgtgtttccagcccccatttccaggttgcagagcgggctctgtatttctggaacaatgagtatatcctaagcctcattgaggacaactgccacactgtgctgcctgctgtgtttgggaccctctaccaagtctccaaggagcactggaaccaaaccatcgtatcactgatctacaatgtgctcaagaccttcatggagatgaatgggaagctgtttgatgagctcacagcctcctacaagctggaaaagcagcaggagcagcagaaggcccaggagcgtcaggagttatggcaaggtctggaggagctgcggctacgccggctacaggggacccagggggccaaggaggcccccctccagcggcttacaccccaggtggccgccagtgggggtcagagctagacagcacctcagaaggggaaaagctaaacccagagctgtcagtccctctatcccttctcctgtccaggggcccagagagaaacacacctacccctggccttgccagagtggcttctgaggactccctgcccagcccagctttcactggggggagacgaggagaggcaatggtggtcttggcaacagaatgctcagcccctcgtggcaggacttgacaagggcaagcttgaccaggaagctgccatcagggatcttcccctgccccgcaaagctaggctccagctgcaggcgggctcccaccctctgctcctggccttgggcaagggcactcagcgcctcgcctgcccctgccttggccaatgcgaggtccttccttatccccaccatggggtccatggtctatttattctcgcccagctcaccctctacacagacactgtcctgggtgcacactcctcccttccctcgctgtgtacttccttgtcccctttttatttattgggcagggggagggggagggcacaggcaagaagagattcacagtgtcctggggtaagggggggttcacagtaatcatggtctactcctctttccgtggctgggggtagacttaataaagagagaaattcaa

SEQ ID NO: 355122 - DNA, 2747 bp, Homo sapiens
ggtggggggaggtgacttgatgtcatcctgagcagctgggcggcgggtgccggtgcgcacggagccgagccggggctcccgttgcgctgcaccgcgttgggtcggagtcccaggacttcagcggagatccgcgcgctgcgacggccggtgcagagcccgccgagcgcccagtcccggcccggggctgagttgggggcatgctctagccgcccccccggagcccgggagagaacccaggagcgccgccgcccagccccagcgccccgagcggaaccgctgcgaaggggccctgaacggccgtcgccctccctacgggcagcccccgggggttggcgaccgaagtctaggttttcgagaaagccagggtgggaaccctaactggactcttcgggacccccaggaaggatctgaggcctgagccatcctcctttctaccctgtctgccccccaggactgggcagttgcaggaggccctgggggggggcccaggactgtggttgtgccccccccccaaaggccggacaggatgggaccaagttagtctgtccagtctcacccagcacctcccaggcccagagagaacccccggggctctgaaagcttgccctgccgcctgaccgccatggagacgaagctgccccctgcaagcacccccactagcccctcctcccccgggctgtcgcctgtgcccccacccgacaaggtggacggcttctcccgccgttccctccgcagagcccggccccgccgctcccacagctcctctcagttccgctatcagagcaaccagcaagagctcacaccgctgcccctgctcaaagatgtgccggcttccgagctgcacgagctgctgagccggaagctggcccagtgtggggtgatgtttgacttcttggactgtgtggccgacctcaaggggaaggaggtgaagcgggcagccctcaacgagctggtggagtgtgtggggagcacccggggtgtcctcatcgagcccgtctacccagacatcatccgcatgatctcagtgaatatcttccggactctgccgcccagtgagaaccctgaatttgaccctgaagaggatgagcccaatcttgagccttcgtggccacacctgcagctggtatatgagtttttcctgcgtttcttggagagcccagacttccagccctccgtggccaagagatatgtggatcaaaagtttgtcctgatgctcctggagctatttgatagtgaggatccccgggagcgtgagtacctcaagaccatcctgcaccgggtctatggcaagttcctgggtctccgggcctacatccgcaaacagtgcaaccacatcttcctccggttcatctatgaattcgagcacttcaatggtgtggctgagctgctggagatcctaggaagcatcatcaatggctttgcgctgcccctgaagacggagcacaagcagttcctggttcgcgtcctgatccccctgcactctgtcaagtcgctgtctgtcttccatgcccagctggcatactgtgtggtgcagttcctggagaaggatgccactctgacagagcacgtgatccgggggctgctcaaatactggccaaaaacctgcacccagaaggaggtgatgtttctgggggagatggaagagattcttgatgtcatcgagccctcccagtttgtgaagatccaggagcccctttttaagcaggtggctcgctgtgtttccagcccccatttccaggttgcagagcgggctctgtatttctggaacaatgagtatatcctaagcctcattgaggacaactgccacactgtgctgcctgctgtgtttgggaccctctaccaagtctccaaggagcactggaaccaaaccatcgtatcactgatctacaatgtgctcaagaccttcatggagatgaatgggaagctgtttgatgagctcacagcctcctacaagctggaaaagcagcaggagcagcagaaggcccaggagcgtcaggagttatggcaaggtctggaggagctgcggctacgccggctacaggggacccagggggccaaggaggcccccctccagcggcttacaccccaggtggccgccagtgggggtcagagctagacagcacctcagaaggggaaaagctaaacccagagctgtcagtccctctatcccttctcctgtccaggggcccagagagaaacacacctacccctggccttgccagagtggcttctgaggactccctgcccagcccagctttcactggggggagacgaggagaggcaatggtggtcttggcaacagaatgctcagcccctcgtggcaggacttgacaagggcaagcttgaccaggaagctgccatcagggatcttcccctgccccgcaaagctaggctccagctgcaggcgggctcccaccctctgctcctggccttgggcaagggcactcagcgcctcgcctgcccctgccttggccaatgcgaggtccttccttatccccaccatggggtccatggtctatttattctcgcccagctcaccctctacacagacactgtcctgggtgcacactcctcccttccctcgctgtgtacttccttgtcccctttttatttattgggcagggggagggggagggcacaggcaagaagagattcacagtgtcctggggtaagggggggttcacagtaatcatggtctactcctctttccgtggctgggggtagacttaataaagagagaaattcaa

SEQ ID NO: 355123 - DNA, 2776 bp, Homo sapiens
ggtggggggaggtgacttgatgtcatcctgagcagctgggcggcgggtgccggtgcgcacggagccgagccggggctcccgttgcgctgcaccgcgttgggtcggagtcccaggacttcagcggagatccgcgcgctgcgacggccggtgcagagcccgccgagcgcccagtcccggcccggggctgagttgggggcatgctctagccgcccccccggagcccgggagagaacccaggagcgccgccgcccagccccagcgccccgagcggaaccgctgcgaaggggccctgaacggccgtcgccctccctacgggcagcccccgggggttggcgaccgaagtctaggttttcgagaaatctttctgcctgacttcgttttcaaaagagccagggtgggaaccctaactggactcttcgggacccccaggaaggatctgaggcctgagccatcctcctttctaccctgtctgccccccaggactgggcagttgcaggaggccctgggggggggcccaggactgtggttgtgccccccccccaaaggccggacaggatgggaccaagttagtctgtccagtctcacccagcacctcccaggcccagagagaacccccggggctctgaaagcttgccctgccgcctgaccgccatggagacgaagctgccccctgcaagcacccccactagcccctcctcccccgggctgtcgcctgtgcccccacccgacaaggtggacggcttctcccgccgttccctccgcagagcccggccccgccgctcccacagctcctctcagttccgctatcagagcaaccagcaagagctcacaccgctgcccctgctcaaagatgtgccggcttccgagctgcacgagctgctgagccggaagctggcccagtgtggggtgatgtttgacttcttggactgtgtggccgacctcaaggggaaggaggtgaagcgggcagccctcaacgagctggtggagtgtgtggggagcacccggggtgtcctcatcgagcccgtctacccagacatcatccgcatgatctcagtgaatatcttccggactctgccgcccagtgagaaccctgaatttgaccctgaagaggatgagcccaatcttgagccttcgtggccacacctgcagctggtatatgagtttttcctgcgtttcttggagagcccagacttccagccctccgtggccaagagatatgtggatcaaaagtttgtcctgatgctcctggagctatttgatagtgaggatccccgggagcgtgagtacctcaagaccatcctgcaccgggtctatggcaagttcctgggtctccgggcctacatccgcaaacagtgcaaccacatcttcctccggttcatctatgaattcgagcacttcaatggtgtggctgagctgctggagatcctaggaagcatcatcaatggctttgcgctgcccctgaagacggagcacaagcagttcctggttcgcgtcctgatccccctgcactctgtcaagtcgctgtctgtcttccatgcccagctggcatactgtgtggtgcagttcctggagaaggatgccactctgacagagcacgtgatccgggggctgctcaaatactggccaaaaacctgcacccagaaggaggtgatgtttctgggggagatggaagagattcttgatgtcatcgagccctcccagtttgtgaagatccaggagcccctttttaagcaggtggctcgctgtgtttccagcccccatttccaggttgcagagcgggctctgtatttctggaacaatgagtatatcctaagcctcattgaggacaactgccacactgtgctgcctgctgtgtttgggaccctctaccaagtctccaaggagcactggaaccaaaccatcgtatcactgatctacaatgtgctcaagaccttcatggagatgaatgggaagctgtttgatgagctcacagcctcctacaagctggaaaagcagcaggagcagcagaaggcccaggagcgtcaggagttatggcaaggtctggaggagctgcggctacgccggctacaggggacccagggggccaaggaggcccccctccagcggcttacaccccaggtggccgccagtgggggtcagagctagacagcacctcagaaggggaaaagctaaacccagagctgtcagtccctctatcccttctcctgtccaggggcccagagagaaacacacctacccctggccttgccagagtggcttctgaggactccctgcccagcccagctttcactggggggagacgaggagaggcaatggtggtcttggcaacagaatgctcagcccctcgtggcaggacttgacaagggcaagcttgaccaggaagctgccatcagggatcttcccctgccccgcaaagctaggctccagctgcaggcgggctcccaccctctgctcctggccttgggcaagggcactcagcgcctcgcctgcccctgccttggccaatgcgaggtccttccttatccccaccatggggtccatggtctatttattctcgcccagctcaccctctacacagacactgtcctgggtgcacactcctcccttccctcgctgtgtacttccttgtcccctttttatttattgggcagggggagggggagggcacaggcaagaagagattcacagtgtcctggggtaagggggggttcacagtaatcatggtctactcctctttccgtggctgggggtagacttaataaagagagaaattcaa

SEQ ID NO: 355124 - DNA, 2138 bp, Homo sapiens
  misc_feature (29)..(29): n is a, c, g, or t
tctgggattaccggcccccccgggggtangcgattcgtcgaccacgcgctcggggccctgaacggccgtcgccctccctacgggcagcccccgggggttggcgaccgaagtctaggttttcgagaaagcccggccccgccgctcccacagctcctctcagttccgctatcagagcaaccagcaagagctcacaccgctgcccctgctcaaagatgtgccggcttccgagctgcacgagctgctgagccggaagctggcccagtgtggggtgatgtttgacttcttggactgtgtggccgacctcaaggggaaggaggtgaagcgggcagccctcaacgagctggtggagtgtgtggggagcacccggggtgtcctcatcgagcccgtctacccagacatcatccgcatgatctcagtgaatatcttccggactctgccgcccagtgagaaccctgaatttgaccctgaagaggatgagcccaatcttgagccttcgtggccacacctgcagctggtatatgagtttttcctgcgtttcttggagagcccagacttccagccctccgtggccaagagatatgtggatcaaaagtttgtcctgatgctcctggagctatttgatagtgaggatccccgggagcgtgagtacctcaagaccatcctgcaccgggtctatggcaagttcctgggtctccgggcctacatccgcaaacagtgcaaccacatcttcctccggttcatctatgaattcgagcacttcaatggtgtggctgagctgctggagatcctaggaagcatcatcaatggctttgcgctgcccctgaagacggagcacaagcagttcctggttcgcgtcctgatccccctgcactctgtcaagtcgctgtctgtcttccatgcccagctggcatactgtgtggtgcagttcctggagaaggatgccactctgacagagcacgtgatccgggggctgctcaaatactggccaaaaacctgcacccagaaggaggtgatgtttctgggggagatggaagagattcttgatgtcatcgagccctcccagtttgtgaagatccaggagcccctttttaagcaggtggctcgctgtgtttccagcccccatttccaggttgcagagcgggctctgtatttctggaacaatgagtatatcctaagcctcattgaggacaactgccacactgtgctgcctgctgtgtttgggaccctctaccaagtctccaaggagcactggaaccaaaccatcgtatcactgatctacaatgtgctcaagaccttcatggagatgaatgggaagctgtttgatgagctcacagcctcctacaagctggaaaagcagcaggagcagcagaaggcccaggagcgtcaggagttatggcaaggtctggaggagctgcggctacgccggctacaggggacccagggggccaaggaggcccccctccagcggcttacaccccaggtggccgccagtgggggtcagagctagacagcacctcagaaggggaaaagctaaacccagagctgtcagtccctctatcccttctcctgtccaggggcccagagagaaacacacctacccctggccttgccagagtggcttctgaggactccctgcccagcccagctttcactggggggagacgaggagaggcaatggtggtcttggcaacagaatgctcagcccctcgtggcaggacttgacaagggcaagcttgaccaggaagctgccatcagggatcttcccctgccccgcaaagctaggctccagctgcaggcgggctcccaccctctgctcctggccttgggcaagggcactcagcgcctcgcctgcccctgccttggccaatgcgaggtccttccttatccccaccatggggtccatggtctatttattctcgcccagctcaccctctacacagacactgtcctgggtgcacactcctcccttccctcgctgtgtacttccttgtcccctttttatttattgggcagggggagggggagggcacaggcaagaagagattcacagtgtcctggggtaagggggggttcacagtaatcatggtctactcctctttccgtggctgggggtagacttaataaagagagaaattcaa

SEQ ID NO: 355125 - DNA, 2624 bp, Homo sapiens
ggtggggggaggtgacttgatgtcatcctgagcagctgggcggcgggtgccggtgcgcacggagccgagccggggctcccgttgcgctgcaccgcgttgggtcggagtcccaggacttcagcggagatccgcgcgctgcgacggccggtgcagagcccgccgagcgcccagtcccggcccggggctgagttgggggcatgctctagccgcccccccggagcccgggagagaacccaggagcgccgccgcccagccccagcgccccgagcggaaccgctgcgaaggggccctgaacggccgtcgccctccctacgggcagcccccgggggttggcgaccgaagtctaggttttcgagaaagccagggtgggaaccctaactggactcttcgggacccccaggaaggatctgaggcctgagccatcctcctttctaccctgtctgccccccaggactgggcagttgcaggaggccctgggggggggcccaggactgtggttgtgccccccccccaaaggccggacaggatgggaccaagttagtctgtccagtctcacccagcacctcccaggcccagagagaacccccggggctctgaaagcttgccctgccgcctgaccgccatggagacgaagctgccccctgcaagcacccccactagcccctcctcccccgggctgtcgcctgtgcccccacccgacaaggtggacggcttctcccgccgttccctccgcagagcccggccccgccgctcccacagctcctctcagttccgctatcagagcaaccagcaagagctcacaccgctgcccctgctcaaagatgtgccggcttccgagctgcacgagctgctgagccggaagctggcccagtgtggggtgatgtttgacttcttggactgtgtggccgacctcaaggggaaggaggtgaagcgggcagccctcaacgagctggtggagtgtgtggggagcacccggggtgtcctcatcgagcccgtctacccagacatcatccgcatgatctcagtgaatatcttccggactctgccgcccagtgagaaccctgaatttgaccctgaagaggatgagcccaatcttgagccttcgtggccacacctgcagctggtatatgagtttttcctgcgtttcttggagagcccagacttccagccctccgtggccaagagatatgtggatcaaaagtttgtcctgatgctcctggagctatttgatagtgaggatccccgggagcgtgagtacctcaagaccatcctgcaccgggtctatggcaagttcctgggtctccgggcctacatccgcaaacagtgcaaccacatcttcctccggttcatctatgaattcgagcacttcaatggtgtggctgagctgctggagatcctaggaagcatcatcaatggctttgcgctgcccctgaagacggagcacgtgatccgggggctgctcaaatactggccaaaaacctgcacccagaaggaggtgatgtttctgggggagatggaagagattcttgatgtcatcgagccctcccagtttgtgaagatccaggagcccctttttaagcaggtggctcgctgtgtttccagcccccatttccaggttgcagagcgggctctgtatttctggaacaatgagtatatcctaagcctcattgaggacaactgccacactgtgctgcctgctgtgtttgggaccctctaccaagtctccaaggagcactggaaccaaaccatcgtatcactgatctacaatgtgctcaagaccttcatggagatgaatgggaagctgtttgatgagctcacagcctcctacaagctggaaaagcagcaggagcagcagaaggcccaggagcgtcaggagttatggcaaggtctggaggagctgcggctacgccggctacaggggacccagggggccaaggaggcccccctccagcggcttacaccccaggtggccgccagtgggggtcagagctagacagcacctcagaaggggaaaagctaaacccagagctgtcagtccctctatcccttctcctgtccaggggcccagagagaaacacacctacccctggccttgccagagtggcttctgaggactccctgcccagcccagctttcactggggggagacgaggagaggcaatggtggtcttggcaacagaatgctcagcccctcgtggcaggacttgacaagggcaagcttgaccaggaagctgccatcagggatcttcccctgccccgcaaagctaggctccagctgcaggcgggctcccaccctctgctcctggccttgggcaagggcactcagcgcctcgcctgcccctgccttggccaatgcgaggtccttccttatccccaccatggggtccatggtctatttattctcgcccagctcaccctctacacagacactgtcctgggtgcacactcctcccttccctcgctgtgtacttccttgtcccctttttatttattgggcagggggagggggagggcacaggcaagaagagattcacagtgtcctggggtaagggggggttcacagtaatcatggtctactcctctttccgtggctgggggtagacttaataaagagagaaattcaa

SEQ ID NO: 355126 - DNA, 1092 bp, Homo sapiens
tatgcctgactgtctgcccctgtatcctcccgtcattcttcgagtagctcagacttgttctgactccctgtagcttcctacagaagccagaaccactcaggccccacccgtcatcttctctgtgactgcaggctgggatctgtctgtcctctgctctcttccctcagtagagggtttttatggagtcacagaacaaaaatggttccatgccttccctttgccggtggggtggtagtgagggagtctggactgtgagggagtctggactgtggggggccccaggaaagggagctgcctcaccctctctccccagggagcagcagaaggcccaggagcgtcaggagttatggcaaggtctggaggagctgcggctacgccggctacaggggacccagggggccaaggaggcccccctccagcggcttacaccccaggtggccgccagtgggggtcagagctagacagcacctcagaaggggaaaagctaaacccagagctgtcagtccctctatcccttctcctgtccaggggcccagagagaaacacacctacccctggccttgccagagtggcttctgaggactccctgcccagcccagctttcactggggggagacgaggagaggcaatggtggtcttggcaacagaatgctcagcccctcgtggcaggacttgacaagggcaagcttgaccaggaagctgccatcagggatcttcccctgccccgcaaagctaggctccagctgcaggcgggctcccaccctctgctcctggccttgggcaagggcactcagcgcctcgcctgcccctgccttggccaatgcgaggtccttccttatccccaccatggggtccatggtctatttattctcgcccagctcaccctctacacagacactgtcctgggtgcacactcctcccttccctcgctgtgtacttccttgtcccctttttatttattgggcagggggagggggagggcacaggcaagaagagattcacagtgtcctggggtaagggggggttcacagtaatcatggtctactcctctttccgtggctgggggtagacttaataaagagagaaattcaa

SEQ ID NO: 355127 - DNA, 2413 bp, Homo sapiens
ggtggggggaggtgacttgatgtcatcctgagcagctgggcggcgggtgccggtgcgcacggagccgagccggggctcccgttgcgctgcaccgcgttgggtcggagtcccaggacttcagcggagatccgcgcgctgcgacggccggtgcagagcccgccgagcgcccagtcccggcccggggctgagttgggggcatgctctagccgcccccccggagcccgggagagaacccaggagcgccgccgcccagccccagcgccccgagcggaaccgctgcgaaggggccctgaacggccgtcgccctccctacgggcagcccccgggggttggcgaccgaagtctaggttttcgagaaagccagggtgggaaccctaactggactcttcgggacccccaggaaggatctgaggcctgagccatcctcctttctaccctgtctgccccccaggactgggcagttgcaggaggccctgggggggggcccaggactgtggttgtgccccccccccaaaggccggacaggatgggaccaagttagtctgtccagtctcacccagcacctcccaggcccagagagaacccccggggctctgaaagcttgccctgccgcctgaccgccatggagacgaagctgccccctgcaagcacccccactagcccctcctcccccgggctgtcgcctgtgcccccacccgacaaggtggacggcttctcccgccgttccctccgcagagcccggccccgccgctcccacagctcctctcagttccgctatcagagcaaccagcaagagctcacaccgctgcccctgctcaaagatgtgccggcttccgagctgcacgagctgctgagccggaagctggcccagtgtggggtgatgtttgacttcttggactgtgtggccgacctcaaggggaaggaggtgaagcgggcagccctcaacgagctggtggagtgtgtggggagcacccggggtgtcctcatcgagcccgtctacccagacatcatccgcatgatctcagtgaatatcttccggactctgccgcccagtgagaaccctgaatttgaccctgaagaggatgagcccaatcttgagccttcgtggccacacctgcagctggtatatgagtttttcctgcgtttcttggagagcccagacttccagccctccgtggccaagagatatgtggatcaaaagtttgtcctgatgctcctggagctatttgatagtgaggatccccgggagcgtgagtacctcaagaccatcctgcaccgggtctatggcaagttcctgggtctccgggcctacatccgcaaacagtgcaaccacatcttcctccggttcatctatgaattcgagcacttcaatggtgtggctgagctgctggagatcctaggaagcatcatcaatggctttgcgctgcccctgaagacggagcacaagcagttcctggttcgcgtcctgatccccctgcactctgtcaagtcgctgtctgtcttccatgcccagctggcatactgtgtggtgcagttcctggagaaggatgccactctgacagagcacgtgatccgggggctgctcaaatactggccaaaaacctgcacccagaaggaggtgatgtttctgggggagatggaagagattcttgatgtcatcgagccctcccagtttgtgaagatccaggagcccctttttaagcaggtggctcgctgtgtttccagcccccatttccaggttgcagagcgggctctgtatttctggaacaatgagtatatcctaagcctcattgaggacaactgccacactgtgctgcctgctgtgtttgggaccctctaccaagtctccaaggagcactggaaccaaaccatcgtatcactgatctacaatgtgctcaagaccttcatggagatgaatgggaagctgtttgatgagctcacagcctcctacaagctggaaaagcagcaggagcagcagaaggcccaggagcgtcaggagttatggcaaggtctggaggagctgcggctacgccggctacaggggacccagggggccaaggaggcccccctccagcggcttacaccccaggtggccgccagtgggggtcagagctagacagcacctcagaaggggaaaagctaaacccagagctgtcagtccctctatcccttctcctgtccaggggcccagagagaaacacacctacccctggccttgccagagtggcttctgaggactcccttccctcgctgtgtacttccttgtcccctttttatttattgggcagggggagggggagggcacaggcaagaagagattcacagtgtcctggggtaagggggggttcacagtaatcatggtctactcctctttccgtggctgggggtagacttaataaagagagaaattcaa

SEQ ID NO: 355128 - DNA, 1676 bp, Homo sapiens
ggtggggggaggtgacttgatgtcatcctgagcagctgggcggcgggtgccggtgcgcacggagccgagccggggctcccgttgcgctgcaccgcgttgggtcggagtcccaggacttcagcggagatccgcgcgctgcgacggccggtgcagagcccgccgagcgcccagtcccggcccggggctgagttgggggcatgctctagccgcccccccggagcccgggagagaacccaggagcgccgccgcccagccccagcgccccgagcggaaccgctgcgaaggggccctgaacggccgtcgccctccctacgggcagcccccgggggttggcgaccgaagtctaggttttcgagaaagccagggtgggaaccctaactggactcttcgggacccccaggaaggatctgaggcctgagccatcctcctttctaccctgtctgccccccaggactgggcagttgcaggaggccctgggggggggcccaggactgtggttgtgccccccccccaaaggccggacaggatgggaccaagttagtctgtccagtctcacccagcacctcccaggcccagagagaacccccggggctctgaaagcttgccctgccgcctgaccgccatggagacgaagctgccccctgcaagcacccccactagcccctcctcccccgggctgtcgcctgtgcccccacccgacaaggtggacggcttctcccgccgttccctccgcagagcccggccccgccgctcccacagctcctctcagttccgctatcagagcaaccagcaagagctcacaccgctgcccctgctcaaagatgtgccggcttccgagctgcacgagctgctgagccggaagctggcccagtgtggggtgatgtttgacttcttggactgtgtggccgacctcaaggggaaggaggtgaagcgggcagccctcaacgagctggtggagtgtgtggggagcacccggggtgtcctcatcgagcccgtctacccagacatcatccgcatgatctcagtgaatatcttccggactctgccgcccagtgagaaccctgaatttgaccctgaagaggatgagcccaatcttgagccttcgtggccacacctgcagctggtatatgagtttttcctgcgtttcttggagagcccagacttccagccctccgtggccaagagatatgtggatcaaaagtttgtcctgatgctcctggagctatttgatagtgaggatccccgggagcgtgagtacctcaagaccatcctgcaccgggtctatggcaagttcctgggtctccgggcctacatccgcaaacagtgcaaccacatcttcctccggttcatctatgaattcgagcacttcaatggtgtggctgagctgctggagatcctaggaagcatcatcaatggctttgcgctgcccctgaagacggagcacgtgatccgggggctgctcaaatactggccaaaaacctgcacccagaaggaggtgatgtttctgggggagatggaagagattcttgatgtcatcgagccctcccagtttgtgaagatccaggagcccctttttaagcaggtggctcgctgtgtttccagcccccatttccaacattgcggagcggactccgcctttccggctcgaagcacttatgctaagccccatttaaaga

SEQ ID NO: 355129 - DNA, 1434 bp, Homo sapiens
ggtggggggaggtgacttgatgtcatcctgagcagctgggcggcgggtgccggtgcgcacggagccgagccggggctcccgttgcgctgcaccgcgttgggtcggagtcccaggacttcagcggagatccgcgcgctgcgacggccggtgcagagcccgccgagcgcccagtcccggcccggggctgagttgggggcatgctctagccgcccccccggagcccgggagagaacccaggagcgccgccgcccagccccagcgccccgagcggaaccgctgcgaaggggccctgaacggccgtcgccctccctacgggcagcccccgggggttggcgaccgaagtctaggttttcgagaaagccagggtgggaaccctaactggactcttcgggacccccaggaaggatctgaggcctgagccatcctcctttctaccctgtctgccccccaggactgggcagttgcaggaggccctgggggggggcccaggactgtggttgtgccccccccccaaaggccggacaggatgggaccaagttagtctgtccagtctcacccagcacctcccaggcccagagagaacccccggggctctgaaagcttgccctgccgcctgaccgccatggagacgaagctgccccctgcaagcacccccactagcccctcctcccccgggctgtcgcctgtgcccccacccgacaaggtggacggcttctcccgccgttccctccgcagagcccggccccgccgctcccacagctcctctcagttccgctatcagagcaaccagcaagagctcacaccgctgcccctgctcaaagatgtgccggcttccgagctgcacgagctgctgagccggaagctggcccagtgtggggtgatgtttgacttcttggactgtgtggccgacctcaaggggaaggaggtgaagcgggcagccctcaacgagctggtggagtgtgtggggagcacccggggtgtcctcatcgagcccgtctacccagacatcatccgcatggtgagcacctgccacccaggctccgagggccggccgagagggcgtgtgagccccgtttcctgtccgcaggacccctgcgtggagaataaccctgtactcatcggcttggcctcagtccacgacttccttccccccgacctgctgctgcccaacacccactgaatgcctccgggcctgccccacgtccacacctttgcttatgcttgcctgagacctggagtgccctgccccacaccccataccatccatggcctggctcaggtgccgcctctgccaagaagccgctgtcaataaccaagctggaaatctctcttttcctgcccgtagacctcacagcttctagccttgttctccccactggattgcacctgcctagaaggcagggatgtgtcccattcactgctgggttcccagcc

SEQ ID NO: 355130 - DNA, 836 bp, Homo sapiens
ggtggggggaggtgacttgatgtcatcctgagcagctgggcggcgggtgccggtgcgcacggagccgagccggggctcccgttgcgctgcaccgcgttgggtcggagtcccaggacttcagcggagatccgcgcgctgcgacggccggtgcagagcccgccgagcgcccagtcccggcccggggctgagttgggggcatgctctagccgcccccccggagcccgggagagaacccaggagcgccgccgcccagccccagcgccccgagcggaaccgctgcgaaggggccctgaacggccgtcgccctccctacgggcagcccccgggggttggcgaccgaagtctaggttttcgagaaagccagggtgggaaccctaactggactcttcgggacccccaggaaggatctgaggcctgagccatcctcctttctaccctgtctgccccccaggactgggcagttgcaggaggccctgggggggggcccaggactgtggttgtgccccccccccaaaggccggacaggatgggaccaagttagtctgtccagtctcacccagcacctcccaggcccagagagaacccccggggctctgaaagcttgccctgccgcctgaccgccatggagacgaagctgccccctgcaagcacccccactagcccctcctcccccgggctgtcgcctgtgccccctttttatttattgggcagggggagggggagggcacaggcaagaagagattcacagtgtcctggggtaagggggggttcacagtaatcatggtctactcctctttccgtggctgggggtagacttaataaagagagaaattcaa

SEQ ID NO: 355131 - DNA, 155 bp, Homo sapiens
ggaaaagacctgggcactccacgcagcctcccggctctcctgaggaactgatgggctttctctgtctctttcttgctgatctttctgcctgacttcgttttcaaaagagccagggtgggaaccctaactggactcttcgggacccccaggaagga

SEQ ID NO: 355132 - DNA, 2515 bp, Homo sapiens
  misc_feature (29)..(29): n is a, c, g, or t
tctgggattaccggcccccccgggggtangcgattcgtcgaccacgcgctcggggccctgaacggccgtcgccctccctacgggcagcccccgggggttggcgaccgaagtctaggttttcgagaaagccagggtgggaaccctaactggactcttcgggacccccaggaaggatctgaggcctgagccatcctcctttctaccctgtctgccccccaggactgggcagttgcaggaggccctgggggggggcccaggactgtggttgtgccccccccccaaaggccggacaggatgggaccaagttagtctgtccagtctcacccagcacctcccaggcccagagagaacccccggggctctgaaagcttgccctgccgcctgaccgccatggagacgaagctgccccctgcaagcacccccactagcccctcctcccccgggctgtcgcctgtgcccccacccgacaaggtggacggcttctcccgccgttccctccgcagagcccggccccgccgctcccacagctcctctcagttccgctatcagagcaaccagcaagagctcacaccgctgcccctgctcaaagatgtgccggcttccgagctgcacgagctgctgagccggaagctggcccagtgtggggtgatgtttgacttcttggactgtgtggccgacctcaaggggaaggaggtgaagcgggcagccctcaacgagctggtggagtgtgtggggagcacccggggtgtcctcatcgagcccgtctacccagacatcatccgcatgatctcagtgaatatcttccggactctgccgcccagtgagaaccctgaatttgaccctgaagaggatgagcccaatcttgagccttcgtggccacacctgcagctggtatatgagtttttcctgcgtttcttggagagcccagacttccagccctccgtggccaagagatatgtggatcaaaagtttgtcctgatgctcctggagctatttgatagtgaggatccccgggagcgtgagtacctcaagaccatcctgcaccgggtctatggcaagttcctgggtctccgggcctacatccgcaaacagtgcaaccacatcttcctccggttcatctatgaattcgagcacttcaatggtgtggctgagctgctggagatcctaggaagcatcatcaatggctttgcgctgcccctgaagacggagcacaagcagttcctggttcgcgtcctgatccccctgcactctgtcaagtcgctgtctgtcttccatgcccagctggcatactgtgtggtgcagttcctggagaaggatgccactctgacagagcacgtgatccgggggctgctcaaatactggccaaaaacctgcacccagaaggaggtgatgtttctgggggagatggaagagattcttgatgtcatcgagccctcccagtttgtgaagatccaggagcccctttttaagcaggtggctcgctgtgtttccagcccccatttccaggttgcagagcgggctctgtatttctggaacaatgagtatatcctaagcctcattgaggacaactgccacactgtgctgcctgctgtgtttgggaccctctaccaagtctccaaggagcactggaaccaaaccatcgtatcactgatctacaatgtgctcaagaccttcatggagatgaatgggaagctgtttgatgagctcacagcctcctacaagctggaaaagcagcaggagcagcagaaggcccaggagcgtcaggagttatggcaaggtctggaggagctgcggctacgccggctacaggggacccagggggccaaggaggcccccctccagcggcttacaccccaggtggccgccagtgggggtcagagctagacagcacctcagaaggggaaaagctaaacccagagctgtcagtccctctatcccttctcctgtccaggggcccagagagaaacacacctacccctggccttgccagagtggcttctgaggactccctgcccagcccagctttcactggggggagacgaggagaggcaatggtggtcttggcaacagaatgctcagcccctcgtggcaggacttgacaagggcaagcttgaccaggaagctgccatcagggatcttcccctgccccgcaaagctaggctccagctgcaggcgggctcccaccctctgctcctggccttgggcaagggcactcagcgcctcgcctgcccctgccttggccaatgcgaggtccttccttatccccaccatggggtccatggtctatttattctcgcccagctcaccctctacacagacactgtcctgggtgcacactcctcccttccctcgctgtgtacttccttgtcccctttttatttattgggcagggggagggggagggcacaggcaagaagagattcacagtgtcctggggtaagggggggttcacagtaatcatggtctactcctctttccgtggctgggggtagacttaataaagagagaaattcaa

SEQ ID NO: 355133 - DNA, 2632 bp, Homo sapiens
gtaaactcagtgcgcgatcttaagcgcgcatctgtggaaacaattaaaaaaagtttgccaaccgctgctctgtagggggcagccacacaaaacctcttacatcatgggcgacttcaggaacagccatagggtctctgtcacccaggctggaatgcgacagcacaatcacagcttactgcagcctctaactcctgggcttatgtgatcttcccacctcagcctcccaaagtattgagattacagagccagggtgggaaccctaactggactcttcgggacccccaggaaggatctgaggcctgagccatcctcctttctaccctgtctgccccccaggactgggcagttgcaggaggccctgggggggggcccaggactgtggttgtgccccccccccaaaggccggacaggatgggaccaagttagtctgtccagtctcacccagcacctcccaggcccagagagaacccccggggctctgaaagcttgccctgccgcctgaccgccatggagacgaagctgccccctgcaagcacccccactagcccctcctcccccgggctgtcgcctgtgcccccacccgacaaggtggacggcttctcccgccgttccctccgcagagcccggccccgccgctcccacagctcctctcagttccgctatcagagcaaccagcaagagctcacaccgctgcccctgctcaaagatgtgccggcttccgagctgcacgagctgctgagccggaagctggcccagtgtggggtgatgtttgacttcttggactgtgtggccgacctcaaggggaaggaggtgaagcgggcagccctcaacgagctggtggagtgtgtggggagcacccggggtgtcctcatcgagcccgtctacccagacatcatccgcatgatctcagtgaatatcttccggactctgccgcccagtgagaaccctgaatttgaccctgaagaggatgagcccaatcttgagccttcgtggccacacctgcagctggtatatgagtttttcctgcgtttcttggagagcccagacttccagccctccgtggccaagagatatgtggatcaaaagtttgtcctgatgctcctggagctatttgatagtgaggatccccgggagcgtgagtacctcaagaccatcctgcaccgggtctatggcaagttcctgggtctccgggcctacatccgcaaacagtgcaaccacatcttcctccggttcatctatgaattcgagcacttcaatggtgtggctgagctgctggagatcctaggaagcatcatcaatggctttgcgctgcccctgaagacggagcacaagcagttcctggttcgcgtcctgatccccctgcactctgtcaagtcgctgtctgtcttccatgcccagctggcatactgtgtggtgcagttcctggagaaggatgccactctgacagagcacgtgatccgggggctgctcaaatactggccaaaaacctgcacccagaaggaggtgatgtttctgggggagatggaagagattcttgatgtcatcgagccctcccagtttgtgaagatccaggagcccctttttaagcaggtggctcgctgtgtttccagcccccatttccaggttgcagagcgggctctgtatttctggaacaatgagtatatcctaagcctcattgaggacaactgccacactgtgctgcctgctgtgtttgggaccctctaccaagtctccaaggagcactggaaccaaaccatcgtatcactgatctacaatgtgctcaagaccttcatggagatgaatgggaagctgtttgatgagctcacagcctcctacaagctggaaaagcagcaggagcagcagaaggcccaggagcgtcaggagttatggcaaggtctggaggagctgcggctacgccggctacaggggacccagggggccaaggaggcccccctccagcggcttacaccccaggtggccgccagtgggggtcagagctagacagcacctcagaaggggaaaagctaaacccagagctgtcagtccctctatcccttctcctgtccaggggcccagagagaaacacacctacccctggccttgccagagtggcttctgaggactccctgcccagcccagctttcactggggggagacgaggagaggcaatggtggtcttggcaacagaatgctcagcccctcgtggcaggacttgacaagggcaagcttgaccaggaagctgccatcagggatcttcccctgccccgcaaagctaggctccagctgcaggcgggctcccaccctctgctcctggccttgggcaagggcactcagcgcctcgcctgcccctgccttggccaatgcgaggtccttccttatccccaccatggggtccatggtctatttattctcgcccagctcaccctctacacagacactgtcctgggtgcacactcctcccttccctcgctgtgtacttccttgtcccctttttatttattgggcagggggagggggagggcacaggcaagaagagattcacagtgtcctggggtaagggggggttcacagtaatcatggtctactcctctttccgtggctgggggtagacttaataaagagagaaattcaa

SEQ ID NO: 355134 - DNA, 2693 bp, Homo sapiens
ggtggggggaggtgacttgatgtcatcctgagcagctgggcggcgggtgccggtgcgcacggagccgagccggggctcccgttgcgctgcaccgcgttgggtcggagtcccaggacttcagcggagatccgcgcgctgcgacggccggtgcagagcccgccgagcgcccagtcccggcccggggctgagttgggggcatgctctagccgcccccccggagcccgggagagaacccaggagcgccgccgcccagccccagcgccccgagcggaaccgctgcgaaggggccctgaacggccgtcgccctccctacgggcagcccccgggggttggcgaccgaagtctaggttttcgagaaagccagggtgggaaccctaactggactcttcgggacccccaggaaggatctgaggcctgagccatcctcctttctaccctgtctgccccccaggactgggcagttgcaggaggccctgggggggggcccaggactgtggttgtgccccccccccaaaggccggacaggatgggaccaagttagtctgtccagtctcacccagcacctcccaggcccagagagaacccccggggctctgaaagcttgccctgccgcctgaccgccatggagacgaagctgccccctgcaagcacccccactagcccctcctcccccgggctgtcgcctgtgcccccacccgacaaggtggacggcttctcccgccgttccctccgcagagcccggccccgccgctcccacagctcctctcagttccgctatcagagcaaccagcaagagctcacaccgctgcccctgctcaaagatgtgccggcttccgagctgcacgagctgctgagccggaagctggcccagtgtggggtgatgtttgacttcttggactgtgtggccgacctcaaggggaaggaggtgaagcgggcagccctcaacgagctggtggagtgtgtggggagcacccggggtgtcctcatcgagcccgtctacccagacatcatccgcatgatctcagtgaatatcttccggactctgccgcccagtgagaaccctgaatttgaccctgaagaggatgagcccaatcttgagccttcgtggccacacctgcagctggtatatgagtttttcctgcgtttcttggagagcccagacttccagccctccgtggccaagagatatgtggatcgtgagtacctcaagaccatcctgcaccgggtctatggcaagttcctgggtctccgggcctacatccgcaaacagtgcaaccacatcttcctccggttcatctatgaattcgagcacttcaatggtgtggctgagctgctggagatcctaggaagcatcatcaatggctttgcgctgcccctgaagacggagcacaagcagttcctggttcgcgtcctgatccccctgcactctgtcaagtcgctgtctgtcttccatgcccagctggcatactgtgtggtgcagttcctggagaaggatgccactctgacagagcacgtgatccgggggctgctcaaatactggccaaaaacctgcacccagaaggaggtgatgtttctgggggagatggaagagattcttgatgtcatcgagccctcccagtttgtgaagatccaggagcccctttttaagcaggtggctcgctgtgtttccagcccccatttccaggttgcagagcgggctctgtatttctggaacaatgagtatatcctaagcctcattgaggacaactgccacactgtgctgcctgctgtgtttgggaccctctaccaagtctccaaggagcactggaaccaaaccatcgtatcactgatctacaatgtgctcaagaccttcatggagatgaatgggaagctgtttgatgagctcacagcctcctacaagctggaaaagcagcaggagcagcagaaggcccaggagcgtcaggagttatggcaaggtctggaggagctgcggctacgccggctacaggggacccagggggccaaggaggcccccctccagcggcttacaccccaggtggccgccagtgggggtcagagctagacagcacctcagaaggggaaaagctaaacccagagctgtcagtccctctatcccttctcctgtccaggggcccagagagaaacacacctacccctggccttgccagagtggcttctgaggactccctgcccagcccagctttcactggggggagacgaggagaggcaatggtggtcttggcaacagaatgctcagcccctcgtggcaggacttgacaagggcaagcttgaccaggaagctgccatcagggatcttcccctgccccgcaaagctaggctccagctgcaggcgggctcccaccctctgctcctggccttgggcaagggcactcagcgcctcgcctgcccctgccttggccaatgcgaggtccttccttatccccaccatggggtccatggtctatttattctcgcccagctcaccctctacacagacactgtcctgggtgcacactcctcccttccctcgctgtgtacttccttgtcccctttttatttattgggcagggggagggggagggcacaggcaagaagagattcacagtgtcctggggtaagggggggttcacagtaatcatggtctactcctctttccgtggctgggggtagacttaataaagagagaaattcaa

SEQ ID NO: 355135 - DNA, 554 bp, Homo sapiens
tatgaatatgccagcagcggcaggaagcctggggggttctgactctccctgcccagcccagctttcactggggggagacgaggagaggcaatggtggtcttggcaacagaatgctcagcccctcgtggcaggacttgacaagggcaagcttgaccaggaagctgccatcagggatcttcccctgccccgcaaagctaggctccagctgcaggcgggctcccaccctctgctcctggccttgggcaagggcactcagcgcctcgcctgcccctgccttggccaatgcgaggtccttccttatccccaccatggggtccatggtctatttattctcgcccagctcaccctctacacagacactgtcctgggtgcacactcctcccttccctcgctgtgtacttccttgtcccctttttatttattgggcagggggagggggagggcacaggcaagaagagattcacagtgtcctggggtaagggggggttcacagtaatcatggtctactcctctttccgtggctgggggtagacttaataaagagagaaattcaa

SEQ ID NO: 355136 - DNA, 1424 bp, Homo sapiens
ggtggggggaggtgacttgatgtcatcctgagcagctgggcggcgggtgccggtgcgcacggagccgagccggggctcccgttgcgctgcaccgcgttgggtcggagtcccaggacttcagcggagatccgcgcgctgcgacggccggtgcagagcccgccgagcgcccagtcccggcccggggctgagttgggggcatgctctagccgcccccccggagcccgggagagaacccaggagcgccgccgcccagccccagcgccccgagcggaaccgctgcgaaggggccctgaacggccgtcgccctccctacgggcagcccccgggggttggcgaccgaagtctaggttttcgagaaagccagggtgggaaccctaactggactcttcgggacccccaggaaggatctgaggcctgagccatcctcctttctaccctgtctgccccccaggactgggcagttgcaggaggccctgggggggggcccaggactgtggttgtgccccccccccaaaggccggacaggatgggaccaagttagtctgtccagtctcacccagcacctcccaggcccagagagaacccccggggctctgaaagcttgccctgccgcctgaccgccatggagacgaagctgccccctgcaagcacccccactagcccctcctcccccgggctgtcgcctgtgcccccacccgacaaggtggacggcttctcccgccgttccctccgcagagcccggccccgccgctcccacagctcctctcagttccgctatcagagcaaccagcaagagctcacaccgctgcccctgctcaaagatgtgccggcttccgagctgcacgagctgctgagccggaagctggcccagtgtggggtgatgtttgacttcttggactgtgtggccgacctcaaggggaaggaggtgaagcgggcagccctcaacgagctggtggagtgtgtggggagcacccggggtgtcctcatcgagcccgtctacccagacatcatccgcatgatctcagtgaatatcttccggactctgccgcccagtgagaaccctgaatttgaccctgaagaggcgggctcccaccctctgctcctggccttgggcaagggcactcagcgcctcgcctgcccctgccttggccaatgcgaggtccttccttatccccaccatggggtccatggtctatttattctcgcccagctcaccctctacacagacactgtcctgggtgcacactcctcccttccctcgctgtgtacttccttgtcccctttttatttattgggcagggggagggggagggcacaggcaagaagagattcacagtgtcctggggtaagggggggttcacagtaatcatggtctactcctctttccgtggctgggggtagacttaataaagagagaaattcaa

SEQ ID NO: 355137 - DNA, 446 bp, Homo sapiens
cccacatctgtttccagacactgagcacagaaataaacacccagctctgtcaaaccactgagccggcaagagaacacgctccatgaacatgcacggaaaccatatcgaggtggagagcaaggggcgctctcctgtgatgtggttggagttttaaaaaccgtgtttgccagtaattctcttgtccctttcatgttgtggcaaagagctggatcttatttctcgtgggctgcgaggtgccagtggcagaagtgatttgctgggtttgcattctgagatcctccaaagctgtctgctatcaaaacacagtcgtgccaggacaatggggcagcctgaagatgaaggtggctttgtagcctctgctcctaagatgatactgacacttaaggacagggttcagggcggggggtgcccagggcacatcctctctagcctgctattagtccaca

SEQ ID NO: 355138 - DNA, 323 bp, Homo sapiens
agtagagacagggtttcaccatgttggccaggctggtctcaaactcctgagctcaggtgatccacctgcctcggcctcccaaagtgctgggattacaggcataagccactatgctcagccaggcttgggtatttggatgggagataatgcggtgagagaggacggtaaagtcaaacaacagaagagggtaaatggcttttcttggatggaagaaaattcttccagctctcccttatgcctagaatctaaaagtcagcttggcaatgcagtgattcagctccactttaaggagacaaactccaccatggaaaggcttggaaacc

SEQ ID NO: 355139 - DNA, 319 bp, Homo sapiens
tccacccgccttggcctcccaaattcctgtgattacaggcatgagccaccatgcctggccttcttcctttttaaataatggcacgagtcccatcatcctcatgatcctccacccttgggatctcatctaaacctagttacctttcaaaggcctcacctcctactcccatcacattggagattagagattcagcatatgaggctgggcacagtggctcatgcctgtaattccagcactttggaaggctgaggcgggtggatcacttgaggtcaggagttcaagaccagcctggccaacgtgatgaaaccccatctctact

SEQ ID NO: 355140 - DNA, 913 bp, Homo sapiens
tgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaatgctcatcatcactgtaggggacctttgaaagagctgccggagaaggtgaggaagaaagccctgcctggaaagcaacagtgaaccaccagtgtcagcaacgtgaagcttgctgcaaggcctgcagtcatgatgaacccagcagcttctagttc

SEQ ID NO: 355141 - DNA, 593 bp, Homo sapiens
ctctgttcttgattttgtgtttttgttctgtttatgggaggatttctaaaaatttttttgtgacttgtggaggtcacatgatttaaacaacccatgctattgtgaaaagaaaacaaaaatttgatcatttctcatgtttgtagaatgtttattatacacctgtaattccagcgcttggggaggctgaggtgggcagatcacttcaggccaagagttcgagaccagcctgggcaacatggtgaaaccctgtctctacgaaatacaaatacatctcaaatacgtttctactaaatacaaaaattagctgggtgtggtggtgtgtgcctgtaattccagctacttgggaggctgaggcaggagaatcatttgagcccgggagatggaggttgcagtgagccgagattgtgccgctgtgctccagcctgggcaacagagcgagatgtctgggaaatgctatgtgtaaaaaatagcaaaccagtgttgtcccaacctgggggaaggtgccttgagttcgtcttggtttcaggggtgaccaatcttttggtcttccctgggccacattggaagaagaaggattgtcctggaccacacat

SEQ ID NO: 355142 - DNA, 3497 bp, Homo sapiens
cccgcccccggccgcccgcgggcccacgggccggcggcgggagtgagcgggagccggcgggcgaagagccgccgcccggcccgcgatgtcaccattgttcagctgggtggccaaggtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttgg

SEQ ID NO: 355143 - DNA, 5679 bp, Homo sapiens
tgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttggttcctttttgagtgtcactgtgtttgtaaagagcattcacaatacggtggaatttcaaaagctggaagagctcgagatcatgcctcaggcaaaggcgtgggtccatcgttcttccgagagggtttgtgtggcgactacaccctcagcgtccctggcaaggtgcagttggctctcgcccattcttgttatggaaacctaagatgatcattgggaagatcagtgatcttgggtcattgatccctggctcagaggatagcggtttccatcataaaccaagatgatgagttcagcctttatccctcgtggttccactagatgtaacttaaaggagttaacatttgaggactttgttctacatcagattttactatttgaatgtttaagatcactttattgaatttgaagatcatcaaattaaataaaatgatttatttaatttggatatcctgatcactgtcaagtgaaatggatctctctctttggtatttaaggaagtttgtctttaaaaaaaaaatagagtgttttcatacatttttgcttatcccataagtacagttgatcaaagtcatagtaggtaaatgctttatgggacagctgacaccttttagaccctaccaggtattgctagcatgtgagctgcagttgtggggtctgagatatttctttgtggtagtttcatacccatactatagagtcatgtatttatttttgcctgttgtgtgatgtaatgcaatcatgttcctttgagtctccatcccttggaaatctgacttcttgcagaaggagtaggcacatcaagatattcaggggtgccccaagagtctgggactttcaaaaaaaaaagatcaggctgaaactgcagtcagatttatgacagctgacagtttttcagaggtcgcacacagtgactctcctctctcaggatgacgaggacctgtgccttcaacaagcaaaatgctgctcacggttgtcctgcttgcagccagtcactgtgtaaagcctctctgatgtgcacttaagagtgggttgctttctcacaaagatggggttctgtgcagtcacaggtcacttccttgacaacacaatcatttctgatctttatcactgtaaccacgtcttctattccataggagtttcttttgattctctcagttgcgggggcatctcttaatcctggggtaaaaggagagattgccatacttagactcactgtgagtctccccggccatttcacgaggagaccacagtgctgccaccagtgcctaaacaggtggctggcattcgagacttcctcctgttccctgggtcagaggatagcggtttccatcataaaccaagatgatgagttcagcctttatccctcgtggttccgctagatgtaacttataggagttaacatttgaggactttgttctgcatcagatcttactatttgaatgtttactgttggattttgggcatcttattactgttactcaaaaacattgactctgcatcaagaaagaaacaagaaagcaataaaacaagaaataattca

SEQ ID NO: 355144 - DNA, 2836 bp, Homo sapiens
ttttatcgatgccactctctgggaccctgtcttgatcctcagaatctcaaccctgtggggagagcagggtggctgtcttactaccagacccactgatcagaaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttgg

SEQ ID NO: 355145 - DNA, 4425 bp, Homo sapiens
tgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaagtgtggatccttcacctgtgggtgagtctaagcaccgcccaggtcagtcttcagctcctgctcctccacctcgtcttaacccctccgcctcctcgccaaacttttttaagtacctaaaacataattccagtggagaacaaagtgggaatgctgtgccaaagagcatctcctaccgtaatgccctgcggaaaaaacttcattcttcttcctctgtgccaaattttctaaaatttctggctcctgtagatgaaaataacacctctgattttatgaacacaaaaagggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttgg

SEQ ID NO: 355146 - DNA, 6104 bp, Homo sapiens
tgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttggttcctttttgagtgtcactgtgtttgtaaagagcattcacaatacggtggaatttcaaaagctggaagagctcgagatcatgcctcaggcaaaggcgtgggtccatcgttcttccgagagggtttgtgtggcgactacaccctcagcgtccctggcaaggtgcagttggctctcgcccattcttgttatggaaacctaagatgatcattgggaagatcagtgatcttgggtcattgatccctggctcagaggatagcggtttccatcataaaccaagatgatgagttcagcctttatccctcgtggttccactagatgtaacttaaaggagttaacatttgaggactttgttctacatcagattttactatttgaatgtttaagatcactttattgaatttgaagatcatcaaattaaataaaatgatttatttaatttggatatcctgatcactgtcaagtgaaatggatctctctctttggtatttaaggaagtttgtctttaaaaaaaaaatagagtgttttcatacatttttgcttatcccataagtacagttgatcaaagtcatagtaggtaaatgctttatgggacagctgacaccttttagaccctaccaggtattgctagcatgtgagctgcagttgtggggtctgagatatttctttgtggtagtttcatacccatactatagagtcatgtatttatttttgcctgttgtgtgatgtaatgcaatcatgttcctttgagtctccatcccttggaaatctgacttcttgcagaaggagtaggcacatcaagatattcaggggtgccccaagagtctgggactttcaaaaaaaaaagatcaggctgaaactgcagtcagatttatgacagctgacagtttttcagaggtcgcacacagtgactctcctctctcaggatgacgaggacctgtgccttcaacaagcaaaatgctgctcacggttgtcctgcttgcagccagtcactgtgtaaagcctctctgatgtgcacttaagagtgggttgctttctcacaaagatggggttctgtgcagtcacaggtcacttccttgacaacacaatcatttctgatctttatcactgtaaccacgtcttctattccataggagtttcttttgattctctcagttgcgggggcatctcttaatcctggggtaaaaggagagattgccatacttagactcactgtgagtctccccggccatttcacgaggagaccacagtgctgccaccagtgcctaaacaggtggctggcattcgagacttcctcctgttccctgggtcagaggatagcggtttccatcataaaccaagatgatgagttcagcctttatccctcgtggttccgctagatgtaacttataggagttaacatttgaggactttgttctgcatcagatcttactatttgaatgtttactgttggattttgggcatcttattactgttactcaaaaacattgactctgcatcaagaaagaaacaagaaagcaataaaacaagaaataattcatgctcacatttttatggtggttttttttttttttttaactttggatttttgcttttcagcccaggagtaaaggaatgccttatgaacacctgtggcctacgtgtggtcatgacccaaccatcagtgagattatttgagatattggtgtctgcatccagtgttgttatctgagtgtttattacgtaagttgtaacacctctacacagggtgtgagtttagcactgatgagaccagctccatcattgtatgtggcagtgagtcctgttacgagattgggttgggcagaaaggactgttgacatgagcctgtggatgtaggttggacagtctcagcctgtgactgactaggcaaggagcggagaggcaactgtgtgaggattctcagagccaaatttttaagccatgttttgggttatatttccccca

SEQ ID NO: 355147 - DNA, 5735 bp, Homo sapiens
tgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttggttcctttttgagtgtcactgtgtttgtaaagagcattcacaatacggtggaatttcaaaagctggaagagctcgagatcatgcctcaggcaaaggcgtgggtccatcgttcttccgagagggtttgtgtggcgactacaccctcagcgtccctggcaaggtgcagttggctctcgcccattcttgttatggaaacctaagatgatcattgggaagatcagtgatcttgggtcattgatccctggctcagaggatagcggtttccatcataaaccaagatgatgagttcagcctttatccctcgtggttccactagatgtaacttaaaggagttaacatttgaggactttgttctacatcagattttactatttgaatgtttaagatcactttattgaatttgaagatcatcaaattaaataaaatgatttatttaatttggatatcctgatcactgtcaagtgaaatggatctctctctttggtatttaaggaagtttgtctttaaaaaaaaaatagagtgttttcatacatttttgcttatcccataagtacagttgatcaaagtcatagtaggtaaatgctttatgggacagctgacaccttttagaccctaccaggtattgctagcatgtgagctgcagttgtggggtctgagatatttctttgtggtagtttcatacccatactatagagtcatgtatttatttttgcctgttgtgtgatgtaatgcaatcatgttcctttgagtctccatcccttggaaatctgacttcttgcagaaggagtaggcacatctcttaatcctggggtaaaaggagagattgccatacttagactcactgtgagtctccccggccatttcacgaggagaccacagtgctgccaccagtgcctaaacaggtggctggcattcgagacttcctcctgttccctgggtcagaggatagcggtttccatcataaaccaagatgatgagttcagcctttatccctcgtggttccgctagatgtaacttataggagttaacatttgaggactttgttctgcatcagatcttactatttgaatgtttactgttggattttgggcatcttattactgttactcaaaaacattgactctgcatcaagaaagaaacaagaaagcaataaaacaagaaataattcatgctcacatttttatggtggttttttttttttttttaactttggatttttgcttttcagcccaggagtaaaggaatgccttatgaacacctgtggcctacgtgtggtcatgacccaaccatcagtgagattatttgagatattggtgtctgcatccagtgttgttatctgagtgtttattacgtaagttgtaacacctctacacagggtgtgagtttagcactgatgagaccagctccatcattgtatgtggcagtgagtcctgttacgagattgggttgggcagaaaggactgttgacatgagcctgtggatgtaggttggacagtctcagcctgtgactgactaggcaaggagcggagaggcaactgtgtgaggattctcagagccaaatttttaagccatgttttgggttatatttccccca

SEQ ID NO: 355148 - DNA, 4179 bp, Homo sapiens
tgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttggaaaaaataataatttcttgattttgcattaactgtgt

SEQ ID NO: 355149 - DNA, 4174 bp, Homo sapiens
tgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggaggtgactcgttcagaggtgtttgttctttgtgtgttggttacgatagtagaagtggcttcccattggtggcatgtccgtgagttcacgtagtacggcagctagcctttcaagaggtgccgtggacggtggagagttaatgaaaggttatggttctaag

SEQ ID NO: 355150 - DNA, 3700 bp, Homo sapiens
tgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttggtgagcattagtaaatctgtttgccagaaccagccttctcttattagaggggaaacatttcctgtctctccatggtgattcttatttttatacctgtagctcttaccagaacagggtattgtttgatagtctaagattagtcaggggtgggttttgtgactttggagtcctccttaacttctgataatcacggggcttcccttagatgccttcatcttgtgggatgtggatccgatccgtgtagatccgatcgctcaccatgagggtctccctagagcagacatttggaggacttggctgaggagccacaggtgtatgtttctcatgaattgccttcctcagccactctgggttgtgagtattgactgatgctgactgtgggcctctgggccctt

SEQ ID NO: 355151 - DNA, 3177 bp, Homo sapiens
tgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatcccgactacccgggggacctctagaacgcc

SEQ ID NO: 355152 - DNA, 1055 bp, Homo sapiens
ttttccttctccattctaagcagcagtatctgttgaagaatagagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttgg

SEQ ID NO: 355153 - DNA, 2730 bp, Homo sapiens
tgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaagtgtggatccttcacctgtgggtgagtctaagcaccgcccaggtcagtcttcagctcctgctcctccacctcgtcttaacccctccgcctcctcgccaaacttttttaagtacctaaaacataattccagtggagaacaaagtgggaatgctgtgccaaagagcatctcctaccgtaatgccctgcggaaaaaacttcattcttcttcctctgtgccaaattttctaaaatttctggctcctgtagatgaaaataacacctctgattttatgaacacaaaaagggactttgaatccaaagcaaaccatcttggtgattctggtgggactcctgtgaagacccggaggcattcctggaggcagcagatattcctccgagtagccaccccgcagaaggcgtgcgattcttccagcagatatgaagtctagcattcctagaggaacgtcatgcaccaggtaaattccgccacgtgcctct

SEQ ID NO: 355154 - DNA, 1949 bp, Homo sapiens
tgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagccttttgccacagctctcggagctcacgagatgtccttttcttgtcctctggtggggggccaaagggcccatcttca

SEQ ID NO: 355155 - DNA, 1589 bp, Homo sapiens
tgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggtgagagaggacaagcaattcttaccttggaaccttctttacaaggaattttagctccactgatttttctgtccttagggaaaaccagatggtcattgacatatcattatttgtctttagttatttacttatgactatttagtaagcagctaatacacatctgaagctt

SEQ ID NO: 355156 - DNA, 378 bp, Homo sapiens
ccttgcagggtgctgtgggcatgtaaatcctccagcgcagcccttggcaggtaagaggtgcttcataagtgtcgtcccccttctcttttctgtggaagctgtgtgttcacctcccatgggaagacattcctagtcccctcccgtgggctcctcctccagtgggctcctcctccagtgctccgcagtggagtagccagcggggcgtcccgaaagagcatggtgcattcattccgtgagtgccagccacactgcatgttccaaataacacgcctctctctctcctcaggtgcctgagatcatcagctccatccgtcaggcggggaagatcgcccggcaggaggagctgcactgcccgtccgagttcgacgacacgttttc

SEQ ID NO: 355157 - DNA, 381 bp, Homo sapiens
ggttaactccctatctcacaacttttatatagaattttttcatgcctctcttttttctcttaataggaatgaattcttccaaaacaaaactagaactgcaaaagcacctgacgacattaaccaatcaggagcaggcgactatttttgaagaggttcaggtacagtacagttgctaatttctagaaggaaagaaaaggcaggcagcttacctgggaaatgctatgtgtaaaaaatagcaaaccagtgttgtcccaacctgggggaaggtgccttgagttcgtcttggtttcaggggtgaccaatcttttggtcttccctgggccacattggaagaagaaggattgtcctggaccacacataaaagacacgatagctgatgag

SEQ ID NO: 355158 - DNA, 425 bp, Homo sapiens
ctccctatctcacaacttttatatagaattttttcatgcctctcttttttctcttaataggaatgaattcttccaaaacaaaactagaactgcaaaagcacctgacgacattaaccaatcaggagcaggcgactatttttgaagaggttcaggtacagtacagttgctaatttctagaaggaaagaaaaggcaggcagcttacctgggaaatgctatgtgtaaaaaatagcaaaccagtgttgtcccaacctgggggaaggtgccttgagttcgtcttggtttcaggggtgaccaatcttttggtcttccctgggccacattggaagaagaaggattgtcctggaccacacataaaagacacgatagctgatgagctgctaaaaaaacaaacaaacaaacaaacaaaaaaaacagcaaaaaaaaa

SEQ ID NO: 355159 - DNA, 4142 bp, Homo sapiens
tgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttgg

SEQ ID NO: 355160 - DNA, 3581 bp, Homo sapiens
cccgcccccggccgcccgcgggcccacgggccggcggcgggagtgagcgggagccggcgggcgaagagccgccgcccggcccgcgatgtcaccattgttcagctgggtggccaagagcgatgaagtaacttgatttgaacaagatcacacagctagtttatggcagaacttaaaaagttcttggacacctgtttttgaggtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttgg

SEQ ID NO: 355161 - DNA, 4181 bp, Homo sapiens
tgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagaacctcactgtggatcgccatcgttggcctgtactgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttgg

SEQ ID NO: 355162 - DNA, 5956 bp, Homo sapiens
tgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttggttcctttttgagtgtcactgtgtttgtaaagagcattcacaatacggtggaatttcaaaagctggaagagctcgagatcatgcctcaggcaaaggcgtgggtccatcgttcttccgagagggtttgtgtggcgactacaccctcagcgtccctggcaaggtgcagttggctctcgcccattcttgttatggaaacctaagatgatcattgggaagatcagtgatcttgggtcattgatccctggctcagaggatagcggtttccatcataaaccaagatgatgagttcagcctttatccctcgtggttccactagatgtaacttaaaggagttaacatttgaggactttgttctacatcagattttactatttgaatgtttaagatcactttattgaatttgaagatcatcaaattaaataaaatgatttatttaatttggatatcctgatcactgtcaagtgaaatggatctctctctttggtatttaaggaagtttgtctttaaaaaaaaaatagagtgttttcatacatttttgcttatcccataagtacagttgatcaaagtcatagtaggtaaatgctttatgggacagctgacaccttttagaccctaccaggtattgctagcatgtgagctgcagttgtggggtctgagatatttctttgtggtagtttcatacccatactatagagtcatgtatttatttttgcctgttgtgtgatgtaatgcaatcatgttcctttgagtctccatcccttggaaatctgacttcttgcagaaggagtaggcacatcaagatattcaggggtgccccaagagtctgggactttcaaaaaaaaaagatcaggctgaaactgcagtcagatttatgacagctgacagtttttcagaggtcgcacacagtgactctcctctctcaggatgacgaggacctgtgccttcaacaagcaaaatgctgctcacggttgtcctgcttgcagccagtcactgtgtaaagcctctctgatgtgcacttaagagtgggttgctttctcacaaagatggggttctgtgcagtcacaggtcacttccttgacaacacaatcatttctgatctttatcactgtaaccacgtcttctattccataggagtttcttttgattctctcagttgcgggggcatctcttaatcctggggtaaaaggagagattgccatacttagactcactgtgagtctccccggccatttcacgaggagaccacagtgctgccaccagtgcctaaacaggtggctggcattcgagacttcctcctgttccctgggtcagaggatagcggtttccatcataaaccaagatgatgagttcagcctttatccctcgtggttccgctagatgtaacttataggagttaacatttgaggactttgttctgcatcagatcttactatttgaatgtttactgttggattttgggcatcttattactgttactcaaaaacattgactctgcatcaagaaagaaacaagaaagcaataaaacaagaaataattcaaaccccacacgcacacaacaaccactgttgggagcctgtggcctcagaaaagtttttaaaccaccttgctgtaggggcgcccggggccccataggtgaccgcgaacctcgggggccaagagcggtccccagaggagaccgccggggctagaacacagggcggggattcccccccgtagtaaaaaacgccccgggggacccgcagctgttcgaacacatccccgaagggtgccgagaggccaaacgggtcacaaccaggagccccggaggcaatatcg

SEQ ID NO: 355163 - DNA, 4050 bp, Homo sapiens
tgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagaggaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttgg

SEQ ID NO: 355164 - DNA, 2234 bp, Homo sapiens
  misc_feature (56)..(56): n is a, c, g, or t
  misc_feature (64)..(64): n is a, c, g, or t
gcccggccggcgccaactaggctaggtcgggccggtgttaattcggccgagggtanaccagcangagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttgg

SEQ ID NO: 355165 - DNA, 4048 bp, Homo sapiens
tgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttgg

SEQ ID NO: 355166 - DNA, 992 bp, Homo sapiens
gagaaatttttccttcggctcataaatgggtaaaaagacgttaacaaacaagcagactccactttggaaatgatagcccttctattgcagagtaatttgaagctctctgaagctcactctaatgacttcataaatcaaagctgcagcttgtaaagatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttgg

SEQ ID NO: 355167 - DNA, 2822 bp, Homo sapiens
tgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttgg

SEQ ID NO: 355168 - DNA, 2676 bp, Homo sapiens
tgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaagtgtggatccttcacctgtgggtgagtctaagcaccgcccaggtcagtcttcagctcctgctcctccacctcgtcttaacccctccgcctcctcgccaaacttttttaagtacctaaaacataattccagtggagaacaaagtgggaatgctgtgccaaagagcatctcctaccgtaatgccctgcggaaaaaacttcattcttcttcctctgtgccaaattttctaaaatttctggctcctgtagatgaaaataacacctctgattttatgaacacaaaaaggcttgatccaagcaacatctggtattctggtggactcctgtgaagaccgagcattctgagcacagatatctccgagtacaccgcagagcgtcgattccacaatagattagcatctagaggacgtagcacagtattcacgt

SEQ ID NO: 355169 - DNA, 3579 bp, Homo sapiens
cacttccccaatctacaggagccattttaacagctaaaacttgtcggattgctttttattttcaagctcaaaagacgatagagaaagaatacttgaaggccaagaagcttgagagaagaaaaatttcagaaaaattgtctcaatttgactagaatatcaatgaaccaggaaaactgaagcaccttccctaaagaaaacttgggtatacaattactccacagacagagctgagggttttttacccaaatcagtcactggattttgctgcctgatacgtgaatcttcttggaatttttctcatgtggatctaaggggaatgctttattatggctgctgttgtccaacagaacgacctagtatttgaatttgctagtaacgtcatggaggatgaacgacagcttggtgatccagctatttttcctgccgtaattgtggaacatgttcctggtgctgatattctcaatagttatgccggtctagcctgtgtggaagagcccagtgacatgattactgagagttcactggatgttgctgaagaagaaatcatagacgatgatgatgatgacatcacccttacagttgaagcttcttgtcatgacggggatgaaacaattgaaactattgaggctgctgaggcactcctcaatatggattcccctggccctatgctggatgaaaaacgaataaataataatatatttagttcacctgaagatgacatggttgttgccccagtcacccatgtgtccgtcacattagatgggattcctgaagtgatggaaacacagcaggtgcaagaaaaatatgcagactcaccgggagcctcatcaccagaacagcctaagaggaaaaaaggaagaaaaactaaaccaccacgaccagattccccagccactacgccaaatatatctgtgaagaagaaaaacaaagatggaaagggaaacacaatttatctttgggagtttttactggcactgctccaggacaaggctacttgtcctaaatacatcaagtggacccagcgagagaaaggcatttttaaattggtggattctaaagcagtgtccaggttgtgggggaagcacaaaaacaaacctgatatgaattatgagaccatgggaagagcactcaggtactattaccaaaggggtattctggcaaaagtggaaggtcagcgcttggtgtatcagtttaaagaaatgccaaaagatcttatatatataaatgatgaggatccaagttccagcatagagtcttcagatccatcgctatcttcatcagccacttcaaataggaatcaaaccagccggtcgagagtatcttcaagtccaggggtaaaaggaggagccactacagttctaaaaccagggaattctaaagctgcaaaacccaaagatcctgtggaagttgcacaaccatcagaagttttgaggacagtgcagcccacgcagtctccatatcctacccagctcttccggactgttcatgtagtacagccagtacaggctgtcccagagggagaagcagctagaaccagtaccatgcaggatgaaacattaaattcttccgttcagagtattaggactatacaggctccaacccaagttccagtggttgtgtctcctaggaatcagcagttgcatacagtaacactccaaacagtgccactcacaacagttatagccagcacagatccatcagcaggtactggatctcagaagtttattttacaagccattccatcatcacagcccatgacagtactgaaagaaaatgtcatgctgcagtcacaaaaggcgggctctcctccttcaattgtcttgggccctgcccaggttcagcaggtccttactagcaatgttcagaccatttgcaatggaaccgtcagtgtggcttcctctccatccttcagtgctactgcacctgtggtgaccttttctcctcgcagttcacagctggttgctcacccacctggcactgtaatcacttcagttatcaaaactcaagaaacaaaaactcttacacaggaagtagagaaaaaggaatctgaagatcatttgaaagagaacactgagaaaacggagcagcagccacagccttatgtgatggtagtgtccagttccaatggatttacttctcaggtagctatgaaacaaaacgaactgctggaacccaactctttttagttaatataccaaagcttatgaataattgtttgttaattgaacattttcaattatatgcagactgactgattctaagataaattctaaggaggtttctaattttgtaattgttaaaaatagagttaattttgactttgttagatgagggaggaaaactcaactgtttctctttgttatctaaatgtttcagaattcaatcgtgaaggaacaggcattttacactatgaagacattcttttgagatttttatttcagttgctatatcataagcatttttaaagtttcttttctaattttacattgtattagattttctgattcttttgtaaatacagaacttaaatagaaggcaacaggaaatttatataggaactattttcattccacttgtgtaagttaagtcttgactctttcaaatgcaaaaaacctattttatgctttgttaaaattatggtgtcacttagattgactttagttgactgcactatataatatagaactatgaatatgtagaataacatgaaaaattggaggtgctggtggtatggctgaccctgtttcagaagcaggatagtataaaagcatcagcctaagaatggcactcccactaactagctatgtaatcttgacctctttgggctttagttcctctcataaaaggaagagatgtattggactagactagatgatcaccactttctcttctagttctaatttttttaattctaatacctatattttcaagttatgtcaattaaatcattatcaggttatttcctaatgtaagaatagctaaaatgttgcagagaaataagtgacccaacaaaatttattcatctattatgggtaagatctgccataaattcttcctaaataatttgtttactaactctttaggccactgtgctttgcggtccattagtaaacttgtgttgctaagtgctaaacagaatactgctattttgagagagtcaagactctttcttaagggccaagaaagcaacttgagccttgggctaatctggctgagtagtcagttataaaagcataattgctttatattttggatcattttttactgggggcggacttggggggggttgcatacaaagataacatatatatccaactttctgaaatgaaatgtttttagattactttttcaactgtaaataatgtacatttaatgtcacaagaaaaaaatgtcttctgcaaattttctagtataacagaaatttttgtagatgaaaaaaatcattatgtttagaggtctaatgctatgttttcatattacagagtgaatttgtatttaaacaaaaatttaaattttggaatcctctaaacatttttgtatctttaattggtttattattaaataaatcatataaaaatt

SEQ ID NO: 355170 - DNA, 497 bp, Homo sapiens
cacttccccaatctacaggagccattttaacagctaaaacttgtcggattgctttttattttcaagctcaaaagacgatagagaaagaatacttgaaggccaagaagcttgagagaagaaaaatttcagaaaaattgtctcaatttgactagaatatcaatgaaccaggaaaactgaagcaccttccctaaagaaaacttgggtatacaattactccacagacagagctgagggttttttacccaaatcagtcactggattttgctgcctgatacgtgaatcttcttggaatttttctcatgtggatctaaggggaatgctttattatggctgctgttgtccaacagaacgacctagtatttgaatttgctagtaacgtcatggaggatgaacgacaggctttggagtcaggggagctgttgaagactgtgggaggagtaaggcaccagacccctcttggtgttttcttgccttgatgcaaagatgttgcgtgaact

SEQ ID NO: 355171 - DNA, 3525 bp, Homo sapiens
cacttccccaatctacaggagccattttaacagctaaaacttgtcggattgctttttattttcaagctcaaaagacgatagagaaagaatacttgaaggccaagaagcttgagagaagaaaaatttcagaaaaattgtctcaatttgactagaatatcaatgaaccaggaaaactgaagcaccttccctaaagaaaacttgggtatacaattactccacagacagagctgagggttttttacccaaatcagtcactggattttgctgcctgatacgtgaatcttcttggaatttttctcatgtggatctaaggggaatgctttattatggctgctgttgtccaacagaacgacctagtatttgaatttgctagtaacgtcatggaggatgaacgacagcttggtgatccagctatttttcctgccgtaattgtggaacatgttcctggtgctgatattctcaatagttatgccggtctagcctgtgtggaagagcccagtgacatgattactgagagttcactggatgttgctgaagaagaaatcatagacgatgatgatgatgacatcacccttacagttgaagcttcttgtcatgacggggatgaaacaattgaaactattgaggctgctgaggcactcctcaatatggattcccctggccctatgctggatgaaaaacgaataaataataatatatttagttcacctgaagatgacatggttgttgccccagtcacccatgtgtccgtcacattagatgggattcctgaagtgatggaaacacagcaggtgcaagaaaaatatgcagactcaccgggagcctcatcaccagaacagcctaagaggaaaaaaggaagaaaaactaaaccaccacgaccagattccccagccactacgccaaatatatctgtgaagaagaaaaacaaagatggaaagggaaacacaatttatctttgggagtttttactggcactgctccaggacaaggctacttgtcctaaatacatcaagtggacccagcgagagaaaggcatttttaaattggtggattctaaagcagtgtccaggttgtgggggaagcacaaaaacaaacctgatatgaattatgagaccatgggaagagcactcaggtactattaccaaaggggtattctggcaaaagtggaaggtcagcgcttggtgtatcagtttaaagaaatgccaaaagatcttatatatataaatgatgaggatccaagttccagcatagagtcttcagatccatcgctatcttcatcagccacttcaaataggaatcaaaccagccggtcgagagtatcttcaagtccaggggtaaaaggaggagccactacagttctaaaaccagggaattctaaagctgcaaaacccaaagatcctgtggaagttgcacaaccatcagaagttttgaggacagtgcagcccacgcagtctccatatcctacccagctcttccggactgttcatgtagtacagccagtacaggctgtcccagagggagaagcagctagaaccagtaccatgcaggatgaaacattaaattcttccgttcagagtattaggactatacaggctccaacccaagttccagtggttgtgtctcctaggaatcagcagttgcatacagtaacactccaaacagtgccactcacaacagttatagccagcacagatccatcagcaggtactggatctcagaagtttattttacaagccattccatcatcacagcccatgacagtactgaaagaaaatgtcatgctgcagtcacaaaaggcgggctctcctccttcaattgtcttgggccctgcccaggttcagcaggtccttactagcaatgttcagaccatttgcaatggaaccgtcagtgtggcttcctctccatccttcagtgctactgcacctgtggtgaccttttctcctcgcagttcacagctggttgctcacccacctggcactgtaatcacttcagttatcaaaactcaagaaacaaaaactcttacacaggaagtagagaaaaaggaatctgaagatcatttgaaagagaacactgagaaaacggagcagcagccacagccttatgtgatggtagtgtccagttccaatggatttacttctcaggtagctatgaaacaaaacgaactgctggaacccaactctttttagttaatataccaaagcttatgaataattgtttgttaattgaacattttcaattatatgcagactgactgattctaagataaattctaaggaggtttctaattttgtaattgttaaaaatagagttaattttgactttgttagatgagggagggaacaggcattttacactatgaagacattcttttgagatttttatttcagttgctatatcataagcatttttaaagtttcttttctaattttacattgtattagattttctgattcttttgtaaatacagaacttaaatagaaggcaacaggaaatttatataggaactattttcattccacttgtgtaagttaagtcttgactctttcaaatgcaaaaaacctattttatgctttgttaaaattatggtgtcacttagattgactttagttgactgcactatataatatagaactatgaatatgtagaataacatgaaaaattggaggtgctggtggtatggctgaccctgtttcagaagcaggatagtataaaagcatcagcctaagaatggcactcccactaactagctatgtaatcttgacctctttgggctttagttcctctcataaaaggaagagatgtattggactagactagatgatcaccactttctcttctagttctaatttttttaattctaatacctatattttcaagttatgtcaattaaatcattatcaggttatttcctaatgtaagaatagctaaaatgttgcagagaaataagtgacccaacaaaatttattcatctattatgggtaagatctgccataaattcttcctaaataatttgtttactaactctttaggccactgtgctttgcggtccattagtaaacttgtgttgctaagtgctaaacagaatactgctattttgagagagtcaagactctttcttaagggccaagaaagcaacttgagccttgggctaatctggctgagtagtcagttataaaagcataattgctttatattttggatcattttttactgggggcggacttggggggggttgcatacaaagataacatatatatccaactttctgaaatgaaatgtttttagattactttttcaactgtaaataatgtacatttaatgtcacaagaaaaaaatgtcttctgcaaattttctagtataacagaaatttttgtagatgaaaaaaatcattatgtttagaggtctaatgctatgttttcatattacagagtgaatttgtatttaaacaaaaatttaaattttggaatcctctaaacatttttgtatctttaattggtttattattaaataaatcatataaaaatt

SEQ ID NO: 355172 - DNA, 3997 bp, Homo sapiens
cacttccccaatctacaggagccattttaacagctaaaacttgtcggattgctttttattttcaagctcaaaagacgatagagaaagaatacttgaaggccaagaagcttgagagaagaaaaatttcagaaaaattgtctcaatttgactagaatatcaatgaaccaggaaaactgaagcaccttccctaaagaaaacttgggtatacaattactccacagacagagctgagggttttttacccaaatcagtcactggattttgctgcctgatacgtgaatcttcttggaatttttctcatgtggatctaaggggaatgctttattatggctgctgttgtccaacagaacgacctagtatttgaatttgctagtaacgtcatggaggatgaacgacagcttggtgatccagctatttttcctgccgtaattgtggaacatgttcctggtgctgatattctcaatagttatgccggtctagcctgtgtggaagagcccagtgacatgattactgagagttcactggatgttgctgaagaagaaatcatagacgatgatgatgatgacatcacccttacagttgaagcttcttgtcatgacggggatgaaacaattgaaactattgaggctgctgaggcactcctcaatatggattcccctggccctatgctggatgaaaaacgaataaataataatatatttagttcacctgaagatgacatggttgttgccccagtcacccatgtgtccgtcacattagatgggattcctgaagtgatggaaacacagcaggtgcaagaaaaatatgcagactcaccgggagcctcatcaccagaacagcctaagaggaaaaaaggaagaaaaactaaaccaccacgaccagattccccagccactacgccaaatatatctgtgaagaagaaaaacaaagatggaaagggaaacacaatttatctttgggagtttttactggcactgctccaggacaaggctacttgtcctaaatacatcaagtggacccagcgagagaaaggcatttttaaattggtggattctaaagcagtgtccaggttgtgggggaagcacaaaaacaaacctgatatgaattatgagaccatgggaagagcactcaggtactattaccaaaggggtattctggcaaaagtggaaggtcagcgcttggtgtatcagtttaaagaaatgccaaaagatcttatatatataaatgatgaggatccaagttccagcatagagtcttcagatccatcgctatcttcatcagccacttcaaataggaatcaaaccagccggtcgagagtatcttcaagtccaggggtaaaaggaggagccactacagttctaaaaccagggaattctaaagctgcaaaacccaaagatcctgtggaagttgcacaaccatcagaagttttgaggacagtgcagcccacgcagtctccatatcctacccagctcttccggactgttcatgtagtacagccagtacaggctgtcccagagggagaagcagctagaaccagtaccatgcaggatgaaacattaaattcttccgttcagagtattaggactatacaggctccaacccaagttccagtggttgtgtctcctaggaatcagcagttgcatacagtaacactccaaacagtgccactcacaacagttatagccagcacagatccatcagcaggtactggatctcagaagtttattttacaagccattccatcatcacagcccatgacagtactgaaagaaaatgtcatgctgcagtcacaaaaggcgggctctcctccttcaattgtcttgggccctgcccaggttcagcaggtccttactagcaatgttcagaccatttgcaatggaaccgtcagtgtggcttcctctccatccttcagtgctactgcacctgtggtgaccttttctcctcgcagttcacagctggttgctcacccacctggcactgtaatcacttcagttatcaaaactcaagaaacaaaaactcttacacaggaagtagagaaaaaggaatctgaagatcatttgaaagagaacactgagaaaacggagcagcagccacagccttatgtgatggtagtgtccagttccaatggatttacttctcaggtagctatgaaacaaaacgaactgctggaacccaactctttttagttaatataccaaagcttatgaataattgtttgttaattgaacattttcaattatatgcagactgactgattctaagataaattctaaggaggtttctaattttgtaattgttaaaaatagagttaattttgactttgttagatgagggaggaaaactcaactgtttctctttgttatctaaatgtttcagaattcaatcgtgaaggaacaggcattttacactatgaagacattcttttgagatttttatttcagttgctatatcataagcatttttaaagtttcttttctaattttacattgtattagattttctgattcttttgtaaatacagaacttaaatagaaggcaacaggaaatttatataggaactattttcattccacttgtgtaagttaagtcttgactctttcaaatgcaaaaaacctattttatgctttgttaaaattatggtgtcacttagattgactttagttgactgcactatataatatagaactatgaatatgtagaataacatgaaaaattggaggtgctggtggtatggctgaccctgtttcagaagcaggatagtataaaagcatcagcctaagaatggcactcccactaactagctatgtaatcttgacctctttgggctttagttcctctcataaaaggaagagatgtattggactagactagatgatcaccactttctcttctagttctaatttttttaattctaatacctatattttcaagttatgtcaattaaatcattatcaggttatttcctaatgtaagaatagctaaaatgttgcagagaaataagtgacccaacaaaatttattcatctattatgggtaagatctgccataaattcttcctaaataatttgtttactaactctttaggccactgtgctttgcggtccattagtaaacttgtgttgctaagtgctaaacagaatactgctattttgagagagtcaagactctttcttaagggccaagaaagcaacttgagccttgggctaatctggctgagtagtcagttataaaagcataattgctttatattttggatcattttttactgggggcggacttggggggggttgcatacaaagataacatatatatccaactttctgaaatgaaatgtttttagattactttttcaactgtaaataatgtacatttaatgtcacaagaaaaaaatgtcttctgcaaattttctagtataacagaaatttttgtagatgaaaaaaatcattatgtttagaggtctaatgctatgttttcatattacagagtgaatttgtatttaaacaaaaatttaaattttggaatcctctaaacatttttgtatctttaattggtttattattaaataaatcatataaaaattaaaaaaaaaaaaaaaaaaaaaaaaaaaaaaaaaaaaaaaaaaaaaaaaaaaaaaacgcagcgacagagagaacgacaggagcgaagacgaaagaaagaggaggcgggacgaagaaagacaaaagcaagagtagaaaggagggacaacacggcgacccacagaaaaccccaacagacccccaaaaccgcaccacaccgaccaaccagcagaagcaccagcacaacacacaacccacacacacagcgaccaccacgacgagagaagcacaacactcacccaggagacccacacacacggaacagcacacaccacccgaacaccccccaagaaaacaggaccaaacagcaccccacacaacaactgacaaccaccaaaaccaccgcacgccacacccccacaacaaaccccagacaaccag

SEQ ID NO: 355173 - DNA, 2353 bp, Homo sapiens
ttcctaattttaagaagctcatgcaactttcttgctaagcattgtaacatcctcctccttccccaacaaaattagctcctcatttgtgttaatgtggccctatgtacagacctttcttccatagcactcagcagatggtatcatagttaatggcctgagagttttgtgttaggcatctctgtatgtagtgtttaatacaaagtctggcatgatattggtcatgctctgttgaaaatatgggaagcagcattttgaaacacataactggtattttgtaaaatgacttgtcaagtgttaaagttttaaatgatgtagaatatgctaattgtctcactttaatttcatcatctcaataggactatacaggctccaacccaagttccagtggttgtgtctcctaggaatcagcagttgcatacagtaacactccaaacagtgccactcacaacagttatagccagcacagatccatcagcaggtactggatctcagaagtttattttacaagccattccatcatcacagcccatgacagtactgaaagaaaatgtcatgctgcagtcacaaaaggcgggctctcctccttcaattgtcttgggccctgcccaggttcagcaggtccttactagcaatgttcagaccatttgcaatggaaccgtcagtgtggcttcctctccatccttcagtgctactgcacctgtggtgaccttttctcctcgcagttcacagctggttgctcacccacctggcactgtaatcacttcagttatcaaaactcaagaaacaaaaactcttacacaggaagtagagaaaaaggaatctgaagatcatttgaaagagaacactgagaaaacggagcagcagccacagccttatgtgatggtagtgtccagttccaatggatttacttctcaggtagctatgaaacaaaacgaactgctggaacccaactctttttagttaatataccaaagcttatgaataattgtttgttaattgaacattttcaattatatgcagactgactgattctaagataaattctaaggaggtttctaattttgtaattgttaaaaatagagttaattttgactttgttagatgagggaggaaaactcaactgtttctctttgttatctaaatgtttcagaattcaatcgtgaaggaacaggcattttacactatgaagacattcttttgagatttttatttcagttgctatatcataagcatttttaaagtttcttttctaattttacattgtattagattttctgattcttttgtaaatacagaacttaaatagaaggcaacaggaaatttatataggaactattttcattccacttgtgtaagttaagtcttgactctttcaaatgcaaaaaacctattttatgctttgttaaaattatggtgtcacttagattgactttagttgactgcactatataatatagaactatgaatatgtagaataacatgaaaaattggaggtgctggtggtatggctgaccctgtttcagaagcaggatagtataaaagcatcagcctaagaatggcactcccactaactagctatgtaatcttgacctctttgggctttagttcctctcataaaaggaagagatgtattggactagactagatgatcaccactttctcttctagttctaatttttttaattctaatacctatattttcaagttatgtcaattaaatcattatcaggttatttcctaatgtaagaatagctaaaatgttgcagagaaataagtgacccaacaaaatttattcatctattatgggtaagatctgccataaattcttcctaaataatttgtttactaactctttaggccactgtgctttgcggtccattagtaaacttgtgttgctaagtgctaaacagaatactgctattttgagagagtcaagactctttcttaagggccaagaaagcaacttgagccttgggctaatctggctgagtagtcagttataaaagcataattgctttatattttggatcattttttactgggggcggacttggggggggttgcatacaaagataacatatatatccaactttctgaaatgaaatgtttttagattactttttcaactgtaaataatgtacatttaatgtcacaagaaaaaaatgtcttctgcaaattttctagtataacagaaatttttgtagatgaaaaaaatcattatgtttagaggtctaatgctatgttttcatattacagagtgaatttgtatttaaacaaaaatttaaattttggaatcctctaaacatttttgtatctttaattggtttattattaaataaatcatataaaaatt

SEQ ID NO: 355174 - DNA, 1520 bp, Homo sapiens
gagagagagagcgagagcgcgagagagagagagagagagagatagagatcgtgagagagagagcgcatgtaaaacggagcagcagccacagccttatgtgatggtagtgtccagttccaatggatttacttctcaggtagctatgaaacaaaacgaactgctggaacccaactctttttagttaatataccaaagcttatgaataattgtttgttaattgaacattttcaattatatgcagactgactgattctaagataaattctaaggaggtttctaattttgtaattgttaaaaatagagttaattttgactttgttagatgagggagggaacaggcattttacactatgaagacattcttttgagatttttatttcagttgctatatcataagcatttttaaagtttcttttctaattttacattgtattagattttctgattcttttgtaaatacagaacttaaatagaaggcaacaggaaatttatataggaactattttcattccacttgtgtaagttaagtcttgactctttcaaatgcaaaaaacctattttatgctttgttaaaattatggtgtcacttagattgactttagttgactgcactatataatatagaactatgaatatgtagaataacatgaaaaattggaggtgctggtggtatggctgaccctgtttcagaagcaggatagtataaaagcatcagcctaagaatggcactcccactaactagctatgtaatcttgacctctttgggctttagttcctctcataaaaggaagagatgtattggactagactagatgatcaccactttctcttctagttctaatttttttaattctaatacctatattttcaagttatgtcaattaaatcattatcaggttatttcctaatgtaagaatagctaaaatgttgcagagaaataagtgacccaacaaaatttattcatctattatgggtaagatctgccataaattcttcctaaataatttgtttactaactctttaggccactgtgctttgcggtccattagtaaacttgtgttgctaagtgctaaacagaatactgctattttgagagagtcaagactctttcttaagggccaagaaagcaacttgagccttgggctaatctggctgagtagtcagttataaaagcataattgctttatattttggatcattttttactgggggcggacttggggggggttgcatacaaagataacatatatatccaactttctgaaatgaaatgtttttagattactttttcaactgtaaataatgtacatttaatgtcacaagaaaaaaatgtcttctgcaaattttctagtataacagaaatttttgtagatgaaaaaaatcattatgtttagaggtctaatgctatgttttcatattacagagtgaatttgtatttaaacaaaaatttaaattttggaatcctctaaacatttttgtatctttaattggtttattattaaataaatcatataaaaatt

SEQ ID NO: 355175 - DNA, 1740 bp, Homo sapiens
cacttccccaatctacaggagccattttaacagctaaaacttgtcggattgctttttattttcaagctcaaaagacgatagagaaagaatacttgaaggccaagaagcttgagagaagaaaaatttcagaaaaattgtctcaatttgactagaatatcaatgaaccaggaaaactgaagcaccttccctaaagaaaacttgggtatacaattactccacagacagagctgagggttttttacccaaatcagtcactggattttgctgcctgatacgtgaatcttcttggaatttttctcatgtggatctaaggggaatgctttattatggctgctgttgtccaacagaacgacctagtatttgaatttgctagtaacgtcatggaggatgaacgacagcttggtgatccagctatttttcctgccgtaattgtggaacatgttcctggtgctgatattctcaatagttatgccggtctagcctgtgtggaagagcccagtgacatgattactgagagttcactggatgttgctgaagaagaaatcatagacgatgatgatgatgacatcacccttacagttgaagcttcttgtcatgacggggatgaaacaattgaaactattgaggctgctgaggcactcctcaatatggattcccctggccctatgctggatgaaaaacgaataaataataatatatttagttcacctgaagatgacatggttgttgccccagtcacccatgtgtccgtcacattagatgggattcctgaagtgatggaaacacagcaggtgcaagaaaaatatgcagactcaccgggagcctcatcaccagaacagcctaagaggaaaaaaggaagaaaaactaaaccaccacgaccagattccccagccactacgccaaatatatctgtgaagaagaaaaacaaagatggaaagggaaacacaatttatctttgggagtttttactggcactgctccaggacaaggctacttgtcctaaatacatcaagtggacccagcgagagaaaggcatttttaaattggtggattctaaagcagtgtccaggttgtgggggaagcacaaaaacaaacctgatatgaattatgagaccatgggaagagcactcaggtactattaccaaaggggtattctggcaaaagtggaaggtcagcgcttggtgtatcagtttaaagaaatgccaaaagatcttatatatataaatgatgaggatccaagttccagcatagagtcttcagatccatcgctatcttcatcagccacttcaaataggaatcaaaccagccggtcgagagtatcttcaagtccaggggtaaaaggaggagccactacagttctaaaaccagggaattctaaagctgcaaaacccaaagatcctgtggaagttgcacaaccatcagaagttttgaggacagtgcagcccacgcagtctccatatcctacccagctcttccggactgttcatgtagtacagccagtacaggctgtcccagagggagaagcagctagaaccagtaccatgcaggatgaaacattaaattcttccgttcagagtattaggtgagaaaaccaaactactgatgcttatcacttcaatatgtttctgaccagagacattatttgttaagtgggtcaagattcagaaatgaaaataaaagtataaaggtttcaagctagaattcttggttaccagatttttcaggagcagttactattat

SEQ ID NO: 355176 - DNA, 695 bp, Homo sapiens
ccaaatggaatccccaaatggaatccccaaatggaatccccaaatggaatcctcaattaaatcattatcaggttatttcctaatgtaagaatagctaaaatgttgcagagaaataagtgacccaacaaaatttattcatctattatgggtaagatctgccataaattcttcctaaataatttgtttactaactctttaggccactgtgctttgcggtccattagtaaacttgtgttgctaagtgctaaacagaatactgctattttgagagagtcaagactctttcttaagggccaagaaagcaacttgagccttgggctaatctggctgagtagtcagttataaaagcataattgctttatattttggatcattttttactgggggcggacttggggggggttgcatacaaagataacatatatatccaactttctgaaatgaaatgtttttagattactttttcaactgtaaataatgtacatttaatgtcacaagaaaaaaatgtcttctgcaaattttctagtataacagaaatttttgtagatgaaaaaaatcattatgtttagaggtctaatgctatgttttcatattacagagtgaatttgtatttaaacaaaaatttaaattttggaatcctctaaacatttttgtatctttaattggtttattattaaataaatcatataaaaatt

SEQ ID NO: 355177 - DNA, 4151 bp, Homo sapiens
gaaggggtaaaagcgcgacgggacctgagctgaaggacgggatctcaagcctcaagtccctgcgccatcccgccgtctctgtgtcctcccctggggcccaaaacctccatcctccttctaggctcgctggctcaaggccaaggagctcagcgcgccgcctccgcccggaacgcaaacagctgttcccagagacgtctccgctctcaactttgccaactactccgcacgcactttgaccagcggagcaaccgggacctgtgggtcggggtcctctggcggagttaaaaaaaaaagaggtgaaactgcgggaccggcgctgcgagtcgctaggcttcgcctcaaactttgctgttgcagcggagcggacccgcccctcctctcccctacgacgcccacgcgctcggatggggcttgttccctagctcgggagcgtgtgggcagaagcagcggcggcggcggcggcggcggcggcggcagcagcagcttcagtagcgcagaggcggcggtggcgagaggtgcggcgaaggaggcagaggcacttatgcttgtcaggccaagaagcttgagagaagaaaaatttcagaaaaattgtctcaatttgactagaatatcaatgaaccaggaaaactgaagcaccttccctaaagaaaacttgggtatacaattactccacagacagagctgagggttttttacccaaatcagtcactggattttgctgcctgatacgtgaatcttcttggaatttttctcatgtggatctaaggggaatgctttattatggctgctgttgtccaacagaacgacctagtatttgaatttgctagtaacgtcatggaggatgaacgacagcttggtgatccagctatttttcctgccgtaattgtggaacatgttcctggtgctgatattctcaatagttatgccggtctagcctgtgtggaagagcccagtgacatgattactgagagttcactggatgttgctgaagaagaaatcatagacgatgatgatgatgacatcacccttacagtggaaacagggtttctccatgttggccagtctcagactcctgacctcaagcaatctgcttgcctcggcttcccaaagtgcgggattacaggaatgagccactgcgccagccaggtttgttgaagcttcttgtcatgacggggatgaaacaattgaaactattgaggctgctgaggcactcctcaatatggattcccctggccctatgctggatgaaaaacgaataaataataatatatttagttcacctgaagatgacatggttgttgccccagtcacccatgtgtccgtcacattagatgggattcctgaagtgatggaaacacagcaggtgcaagaaaaatatgcagactcaccgggagcctcatcaccagaacagcctaagaggaaaaaaggaagaaaaactaaaccaccacgaccagattccccagccactacgccaaatatatctgtgaagaagaaaaacaaagatggaaagggaaacacaatttatctttgggagtttttactggcactgctccaggacaaggctacttgtcctaaatacatcaagtggacccagcgagagaaaggcatttttaaattggtggattctaaagcagtgtccaggttgtgggggaagcacaaaaacaaacctgatatgaattatgagaccatgggaagagcactcaggtactattaccaaaggggtattctggcaaaagtggaaggtcagcgcttggtgtatcagtttaaagaaatgccaaaagatcttatatatataaatgatgaggatccaagttccagcatagagtcttcagatccatcgctatcttcatcagccacttcaaataggaatcaaaccagccggtcgagagtatcttcaagtccaggggtaaaaggaggagccactacagttctaaaaccagggaattctaaagctgcaaaacccaaagatcctgtggaagttgcacaaccatcagaagttttgaggacagtgcagcccacgcagtctccatatcctacccagctcttccggactgttcatgtagtacagccagtacaggctgtcccagagggagaagcagctagaaccagtaccatgcaggatgaaacattaaattcttccgttcagagtattaggactatacaggctccaacccaagttccagtggttgtgtctcctaggaatcagcagttgcatacagtaacactccaaacagtgccactcacaacagttatagccagcacagatccatcagcaggtactggatctcagaagtttattttacaagccattccatcatcacagcccatgacagtactgaaagaaaatgtcatgctgcagtcacaaaaggcgggctctcctccttcaattgtcttgggccctgcccaggttcagcaggtccttactagcaatgttcagaccatttgcaatggaaccgtcagtgtggcttcctctccatccttcagtgctactgcacctgtggtgaccttttctcctcgcagttcacagctggttgctcacccacctggcactgtaatcacttcagttatcaaaactcaagaaacaaaaactcttacacaggaagtagagaaaaaggaatctgaagatcatttgaaagagaacactgagaaaacggagcagcagccacagccttatgtgatggtagtgtccagttccaatggatttacttctcaggtagctatgaaacaaaacgaactgctggaacccaactctttttagttaatataccaaagcttatgaataattgtttgttaattgaacattttcaattatatgcagactgactgattctaagataaattctaaggaggtttctaattttgtaattgttaaaaatagagttaattttgactttgttagatgagggaggaaaactcaactgtttctctttgttatctaaatgtttcagaattcaatcgtgaaggaacaggcattttacactatgaagacattcttttgagatttttatttcagttgctatatcataagcatttttaaagtttcttttctaattttacattgtattagattttctgattcttttgtaaatacagaacttaaatagaaggcaacaggaaatttatataggaactattttcattccacttgtgtaagttaagtcttgactctttcaaatgcaaaaaacctattttatgctttgttaaaattatggtgtcacttagattgactttagttgactgcactatataatatagaactatgaatatgtagaataacatgaaaaattggaggtgctggtggtatggctgaccctgtttcagaagcaggatagtataaaagcatcagcctaagaatggcactcccactaactagctatgtaatcttgacctctttgggctttagttcctctcataaaaggaagagatgtattggactagactagatgatcaccactttctcttctagttctaatttttttaattctaatacctatattttcaagttatgtcaattaaatcattatcaggttatttcctaatgtaagaatagctaaaatgttgcagagaaataagtgacccaacaaaatttattcatctattatgggtaagatctgccataaattcttcctaaataatttgtttactaactctttaggccactgtgctttgcggtccattagtaaacttgtgttgctaagtgctaaacagaatactgctattttgagagagtcaagactctttcttaagggccaagaaagcaacttgagccttgggctaatctggctgagtagtcagttataaaagcataattgctttatattttggatcattttttactgggggcggacttggggggggttgcatacaaagataacatatatatccaactttctgaaatgaaatgtttttagattactttttcaactgtaaataatgtacatttaatgtcacaagaaaaaaatgtcttctgcaaattttctagtataacagaaatttttgtagatgaaaaaaatcattatgtttagaggtctaatgctatgttttcatattacagagtgaatttgtatttaaacaaaaatttaaattttggaatcctctaaacatttttgtatctttaattggtttattattaaataaatcatataaaaatt

SEQ ID NO: 355178 - DNA, 3872 bp, Homo sapiens
cacttccccaatctacaggagccattttaacagctaaaacttgtcggattgctttttattttcaagctcaaaagacgatagagaaagaatacttgaaggccaagaagcttgagagaagaaaaatttcagaaaaattgtctcaatttgactagaatatcaatgaaccaggaaaactgaagcaccttccctaaagaaaacttgggtatacaattactccacagacagagctgagggttttttacccaaatcagtcactggattttgctgcctgatacgtgaatcttcttggaatttttctcatgtggatctaaggggaatgctttattatggctgctgttgtccaacagaacgacctagtatttgaatttgctagtaacgtcatggaggatgaacgacagcttggtgatccagctatttttcctgccgtaattgtggaacatgttcctggtgctgatattctcaatagttatgccggtctagcctgtgtggaagagcccagtgacatgattactgagagttcactggatgttgctgaagaagaaatcatagacgatgatgatgatgacatcacccttacagttgaagcttcttgtcatgacggggatgaaacaattgaaactattgaggctgctgaggcactcctcaatatggattcccctggccctatgctggatgaaaaacgaataaataataatatatttagttcacctgaagatgacatggttgttgccccagtcacccatgtgtccgtcacattagatgggattcctgaagtgatggaaacacagcaggtgcaagaaaaatatgcagactcaccgggagcctcatcaccagaacagcctaagaggaaaaaaggaagaaaaactaaaccaccacgaccagattccccagccactacgccaaatatatctgtgaagaagaaaaacaaagatggaaagggaaacacaatttatctttgggagtttttactggcactgctccaggacaaggctacttgtcctaaatacatcaagtggacccagcgagagaaaggcatttttaaattggtggattctaaagcagtgtccaggttgtgggggaagcacaaaaacaaacctgatatgaattatgagaccatgggaagagcactcaggtactattaccaaaggggtattctggcaaaagtggaaggtcagcgcttggtgtatcagtttaaagaaatgccaaaagatcttatatatataaatgatgaggatccaagttccagcatagagtcttcagatccatcgctatcttcatcagccacttcaaataggaatcaaaccagccggtcgagagtatcttcaagtccaggggtaaaaggaggagccactacagttctaaaaccagggaattctaaagctgcaaaacccaaagatcctgtggaagttgcacaaccatcagaagttttgaggacagtgcagcccacgcagtctccatatcctacccagctcttccggactgttcatgtagtacagccagtacaggctgtcccagagggagaagcagctagaaccagtaccatgcaggatgaaacattaaattcttccgttcagagtattaggactatacaggctccaacccaagttccagtggttgtgtctcctaggaatcagcagttgcatacagtaacactccaaacagtgccactcacaacagttatagccagcacagatccatcagcaggtactggatctcagaagtttattttacaagccattccatcatcacagcccatgacagtactgaaagaaaatgtcatgctgcagtcacaaaaggcgggctctcctccttcaattgtcttgggccctgcccaggttcagcaggtccttactagcaatgttcagaccatttgcaatggaaccgtcagtgtggcttcctctccatccttcagtgctactgcacctgtggtgaccttttctcctcgcagttcacagctggttgctcacccacctggcactgtaatcacttcagttatcaaaactcaagaaacaaaaactcttacacaggaagtagagaaaaaggaatctgaagatcatttgaaagagaacactgagaaaacggagcagcagccacagccttatgtgatggtagtgtccagttccaatggatttacttctcaggtagctatgaaacaaaacgaactgctggaacccaactctttttagttaatataccaaagcttatgaataattgtttgttaattgaacattttcaattatatgcagactgactgattctaagataaattctaaggaggtttctaattttgtaattgttaaaaatagagttaattttgactttgttagatgagggaggaaaactcaactgtttctctttgttatctaaatgtttcagaattcaatcgtgaaggaacaggcattttacactatgaagacattcttttgagatttttatttcagttgctatatcataagcatttttaaagtttcttttctaattttacattgtattagattttctgattcttttgtaaatacagaacttaaatagaaggcaacaggaaatttatataggaactattttcattccacttgtgtaagttaagtcttgactctttcaaatgcaaaaaacctattttatgctttgttaaaattatggtgtcacttagattgactttagttgactgcactatataatatagaactatgaatatgtagaataacatgaaaaattggaggtgctggtggtatggctgaccctgtttcagaagcaggatagtataaaagcatcagcctaagaatggcactcccactaactagctatgtaatcttgacctctttgggctttagttcctctcataaaaggaagagatgtattggactagactagatgatcaccactttctcttctagttctaatttttttaattctaatacctatattttcaagttatgtcaattaaatcattatcaggttatttcctaatgtaagaatagctaaaatgttgcagagaaataagtgacccaacaaaatttattcatctattatgggtaagatctgccataaattcttcctaaataatttgtttactaactctttaggccactgtgctttgcggtccattagtaaacttgtgttgctaagtgctaaacagaatactgctattttgagagagtcaagactctttcttaagggccaagaaagcaacttgagccttgggctaatctggctgagtagtcagttataaaagcataattgctttatattttggatcattttttactgggggcggacttggggggggttgcatacaaagataacatatatatccaactttctgaaatgaaatgtttttagattactttttcaactgtaaataatgtacatttaatgtcacaagaaaaaaatgtcttctgcaaattttctagtataacagaaatttttgtagatgaaaaaaatcattatgtttagaggtctaatgctatgttttcatattacagagtgaatttgtatttaaacaaaaatttaaattttggaatcctctaaacatttttgtatctttaattggtttattattaaataaatcatataaaaattaaaaaaaaaaaacgagagcaagagctcctcatgcgtatgataaccaagtacccagcacgaaatcagcatcaacccacaaaatcaggcgcccgggcgcaactaaatcctcaggggagcacaatctggtcgcacaccagttgtaggaaggggccgcccacgaagctataaataaggacggggcgccgtaaacacgctgcgagaaacggctgtactttggacagcccatctggtggagcaatgagcaccacacagattagcctggaaaaatcggttgggacccacggtcggatttg

SEQ ID NO: 355179 - DNA, 3961 bp, Homo sapiens
gaaggggtaaaagcgcgacgggacctgagctgaaggacgggatctcaagcctcaagtccctgcgccatcccgccgtctctgtgtcctcccctggggcccaaaacctccatcctccttctaggctcgctggctcaaggccaaggagctcagcgcgccgcctccgcccggaacgcaaacagctgttcccagagacgtctccgctctcaactttgccaactactccgcacgcactttgaccagcggagcaaccgggacctgtgggtcggggtcctctggcggagttaaaaaaaaaagaggtgaaactgcgggaccggcgctgcgagtcgctaggcttcgcctcaaactttgctgttgcagcggagcggacccgcccctcctctcccctacgacgcccacgcgctcggatggggcttgttccctagctcgggagcgtgtgggcagaagcagcggcggcggcggcggcggcggcggcggcagcagcagcttcagtagcgcagaggcggcggtggcgagaggtgcggcgaaggaggcagaggcacttatgcttgtcaggccaagaagcttgagagaagaaaaatttcagaaaaattgtctcaatttgactagaatatcaatgaaccaggaaaactgaagcaccttccctaaagaaaacttgggtatacaattactccacagacagagctgagggttttttacccaaatcagtcactggattttgctgcctgatacgtgaatcttcttggaatttttctcatgtggatctaaggggaatgctttattatggctgctgttgtccaacagaacgacctagtatttgaatttgctagtaacgtcatggaggatgaacgacagcttggtgatccagctatttttcctgccgtaattgtggaacatgttcctggtgctgatattctcaatagttatgccggtctagcctgtgtggaagagcccagtgacatgattactgagagttcactggatgttgctgaagaagaaatcatagacgatgatgatgatgacatcacccttacagttgaagcttcttgtcatgacggggatgaaacaattgaaactattgaggctgctgaggcactcctcaatatggattcccctggccctatgctggatgaaaaacgaataaatgggattcctgaagtgatggaaacacagcaggtgcaagaaaaatatgcagactcaccgggagcctcatcaccagaacagcctaagaggaaaaaaggaagaaaaactaaaccaccacgaccagattccccagccactacgccaaatatatctgtgaagaagaaaaacaaagatggaaagggaaacacaatttatctttgggagtttttactggcactgctccaggacaaggctacttgtcctaaatacatcaagtggacccagcgagagaaaggcatttttaaattggtggattctaaagcagtgtccaggttgtgggggaagcacaaaaacaaacctgatatgaattatgagaccatgggaagagcactcaggtactattaccaaaggggtattctggcaaaagtggaaggtcagcgcttggtgtatcagtttaaagaaatgccaaaagatcttatatatataaatgatgaggatccaagttccagcatagagtcttcagatccatcgctatcttcatcagccacttcaaataggaatcaaaccagccggtcgagagtatcttcaagtccaggggtaaaaggaggagccactacagttctaaaaccagggaattctaaagctgcaaaacccaaagatcctgtggaagttgcacaaccatcagaagttttgaggacagtgcagcccacgcagtctccatatcctacccagctcttccggactgttcatgtagtacagccagtacaggctgtcccagagggagaagcagctagaaccagtaccatgcaggatgaaacattaaattcttccgttcagagtattaggactatacaggctccaacccaagttccagtggttgtgtctcctaggaatcagcagttgcatacagtaacactccaaacagtgccactcacaacagttatagccagcacagatccatcagcaggtactggatctcagaagtttattttacaagccattccatcatcacagcccatgacagtactgaaagaaaatgtcatgctgcagtcacaaaaggcgggctctcctccttcaattgtcttgggccctgcccaggttcagcaggtccttactagcaatgttcagaccatttgcaatggaaccgtcagtgtggcttcctctccatccttcagtgctactgcacctgtggtgaccttttctcctcgcagttcacagctggttgctcacccacctggcactgtaatcacttcagttatcaaaactcaagaaacaaaaactcttacacaggaagtagagaaaaaggaatctgaagatcatttgaaagagaacactgagaaaacggagcagcagccacagccttatgtgatggtagtgtccagttccaatggatttacttctcaggtagctatgaaacaaaacgaactgctggaacccaactctttttagttaatataccaaagcttatgaataattgtttgttaattgaacattttcaattatatgcagactgactgattctaagataaattctaaggaggtttctaattttgtaattgttaaaaatagagttaattttgactttgttagatgagggaggaaaactcaactgtttctctttgttatctaaatgtttcagaattcaatcgtgaaggaacaggcattttacactatgaagacattcttttgagatttttatttcagttgctatatcataagcatttttaaagtttcttttctaattttacattgtattagattttctgattcttttgtaaatacagaacttaaatagaaggcaacaggaaatttatataggaactattttcattccacttgtgtaagttaagtcttgactctttcaaatgcaaaaaacctattttatgctttgttaaaattatggtgtcacttagattgactttagttgactgcactatataatatagaactatgaatatgtagaataacatgaaaaattggaggtgctggtggtatggctgaccctgtttcagaagcaggatagtataaaagcatcagcctaagaatggcactcccactaactagctatgtaatcttgacctctttgggctttagttcctctcataaaaggaagagatgtattggactagactagatgatcaccactttctcttctagttctaatttttttaattctaatacctatattttcaagttatgtcaattaaatcattatcaggttatttcctaatgtaagaatagctaaaatgttgcagagaaataagtgacccaacaaaatttattcatctattatgggtaagatctgccataaattcttcctaaataatttgtttactaactctttaggccactgtgctttgcggtccattagtaaacttgtgttgctaagtgctaaacagaatactgctattttgagagagtcaagactctttcttaagggccaagaaagcaacttgagccttgggctaatctggctgagtagtcagttataaaagcataattgctttatattttggatcattttttactgggggcggacttggggggggttgcatacaaagataacatatatatccaactttctgaaatgaaatgtttttagattactttttcaactgtaaataatgtacatttaatgtcacaagaaaaaaatgtcttctgcaaattttctagtataacagaaatttttgtagatgaaaaaaatcattatgtttagaggtctaatgctatgttttcatattacagagtgaatttgtatttaaacaaaaatttaaattttggaatcctctaaacatttttgtatctttaattggtttattattaaataaatcatataaaaatt

SEQ ID NO: 355180 - DNA, 2502 bp, Homo sapiens
cacttccccaatctacaggagccattttaacagctaaaacttgtcggattgctttttattttcaagctcaaaagacgatagagaaagaatacttgaaggccaagaagcttgagagaagaaaaatttcagaaaaattgtctcaatttgactagaatatcaatgaaccaggaaaactgaagcaccttccctaaagaaaacttgggtatacaattactccacagacagagctgagggttttttacccaaatcagtcactggattttgctgcctgatacgtgaatcttcttggaatttttctcatgtggatctaaggggaatgctttattatggctgctgttgtccaacagaacgacctagtatttgaatttgctagtaacgtcatggaggatgaacgacagcttggtgatccagctatttttcctgccgtaattgtggaacatgttcctggtgctgatattctcaatagttatgccggtctagcctgtgtggaagagcccagtgacatgattactgagagttcactggatgttgctgaagaagaaatcatagacgatgatgatgatgacatcacccttacagttgaagcttcttgtcatgacggggatgaaacaattgaaactattgaggctgctgaggcactcctcaatatggattcccctggccctatgctggatgaaaaacgaataaataataatatatttagttcacctgaagatgacatggttgttgccccagtcacccatgtgtccgtcacattagatgggattcctgaagtgatggaaacacagcaggtgcaagaaaaatatgcagactcaccgggagcctcatcaccagaacagcctaagaggaaaaaaggaagaaaaactaaaccaccacgaccagattccccagccactacgccaaatatatctgtgaagaagaaaaacaaagatggaaagggaaacacaatttatctttgggagtttttactggcactgctccaggacaaggctacttgtcctaaatacatcaagtggacccagcgagagaaaggcatttttaaattggtggattctaaagcagtgtccaggttgtgggggaagcacaaaaacaaacctgatatgaattatgagaccatgggaagagcactcaggtactattaccaaaggggtattctggcaaaagtggaaggtcagcgcttggtgtatcagtttaaagaaatgccaaaagatcttatatatataaatgatgaggatccaagttccagcatagagtcttcagatccatcgctatcttcatcagccacttcaaataggaatcaaaccagccggtcgagagtatcttcaagtccaggggtaaaaggaggagccactacagttctaaaaccagggaattctaaagctgcaaaacccaaagatcctgtggaagttgcacaaccatcagaagttttgaggacagtgcagcccacgcagtctccatatcctacccagctcttccggactgttcatgtagtacagccagtacaggctgtcccagagggagaagcagctagaaccagtaccatgcaggatgaaacattaaattcttccgttcagagtattaggactatacaggctccaacccaagttccagtggttgtgtctcctaggaatcagcagttgcatacagtaacactccaaacagtgccactcacaacagttatagccagcacagatccatcagcaggtactggatctcagaagtttattttacaagccattccatcatcacagcccatgacagtactgaaagaaaatgtcatgctgcagtcacaaaaggcgggctctcctccttcaattgtcttgggccctgcccaggttcagcaggtccttactagcaatgttcagaccatttgcaatggaaccgtcagtgtggcttcctctccatccttcagtgctactgcacctgtggtgaccttttctcctcgcagttcacagctggttgctcacccacctggcactgtaatcacttcagttatcaaaactcaagaaacaaaaactcttacacaggaagtagagaaaaaggaatctgaagatcatttgaaagagaacactgagaaaacggagcagcagccacagccttatgtgatggtagtgtccagttccaatggatttacttctcagttctggagtctgggaagtccgatatcaatgcaccagcaggtttgacggttctcattccaaacagtgcctgaacaccgtgtcctctggaggggaagaaggcttcatcttcaaatggcgaagacagaaaagcaaagacagcccacttccacttccaaaagactttttatttatttatttatttatttttttgagacagatttttgctcttgatgcccaggctggagtgcaatggcgtgatctcagctcacctcaacttccgtctcccaggttcaagtgattcttctacctcagcctcccaagtagctgggattacaggcatgtgccaccacgcccggctaattttctatttttagtaaaggtg

SEQ ID NO: 355181 - DNA, 2491 bp, Homo sapiens
ggaaacatcccgtccccgaccgcacccgcccgaagctgggtcaaggagcccagcaggacgggagcgcggcgcccccgacgcccgggaactggctcccccggttcccatctggtgacctcacctggtcccaccctttcaggtgaacggccaggcccggtgacgtcacttcctgccagaagcacctctctccctcgctccgcccttcacccagacgctcgccaatccgtgtgtggttccgagccggacttcatttccccgaaggcgtcgcggcctgaggagacccgttgggtcctcagcgtcttggcggcagttggtggaaccggagcttcgagtccgtccccggtgctgcctgcgcgttcacctgagtctcgctggagctcttctcgcccgcccacctcatctcaacccactttccgcggggagcggcgccaagctgggccttcctcggatcaggcgtcccctgaagtcggcacgcccctctgcgtcccccttcggtcccgctaggaccccgtccgggctgccgtcgcctcgtcgctatggcgcccaccatccagacccaggcccagcgggaggatggccacaggcccaattcccaccggactctgcctgagaggtctggagtggtctgccgagtcaagtactgcaatagcctccctgatatccccttcgaccccaagttcatcacctaccccttcgaccagaacaggttcgtccagtacaaagccacttccttggagaaacagcacaaacatgacctcctgactgagccagacctgggggtcaccatcgatctcatcaatcctgacacctaccgcatcgaccccaatgttcttctagatccagctgatgagaaacttttggaagaggagattcaggcccccaccagctccaagagatcccagcagcacgcgaaggtggtgccatggatgcgaaagacagagtacatctccactgagttcaaccgttatggcatctccaatgagaagcctgaggtcaagattggggtttctgtgaagcagcagtttaccgaggaagaaatatacaaagacagggatagccagatcacagccattgagaagacttttgaggatgcccagaaatcaatctcacagcattacagcaaaccccgagtcacaccggtggaggtcatgcctgtcttcccagactttaagatgtggatcaatccatgtgctcaggtgatctttgactcagacccagcccccaaggacacgagtggtgcagctgcgttggagatgatgtctcaggccatgattaggggcatgatggatgaggaagggaaccagtttgtggcctatttcctgcctgtagaagagacgttgaagaaacgaaagcgggaccaggaggaggagatggactatgcaccagatgatgtgtatgactacaaaattgctcgggagtacaactggaacgtgaagaacaaagctagcaagggctatgaggaaaactacttcttcatcttccgagagggtgacggggtttactacaatgagttggaaaccagggtccgccttagtaagcgccgggccaaggctggggttcagtcaggcaccaacgccctgcttgtggtcaaacatcgggacatgaatgagaaggaactggaagctcaggaggcacggaaggcccagctagaaaaccacgaaccggaggaggaagaggaagaggagatggagacagaagagaaagaagctgggggctcagatgaggagcaggagaagggcagcagcagtgagaaggagggcagtgaagatgagcactcgggcagcgagagtgaacgggaggaaggtgacagggacgaggccagtgacaagagtggcagtggtgaggacgagagcagcgaggatgaggcccgggctgcccgtgacaaagaggagatctttggcagtgatgctgattctgaggacgatgccgactctgatgatgaggacagaggacaggcccaaggtggcagtgacaatgattcagacagcggcagcaatgggggtggccagcggagccggagccacagccgcagcgccagtcccttccccagtggcagcgagcactcggcccaggaggatggcagtgaagctgcagcttctgattccagtgaagctgatagtgacagtgactgagtcccagggcattcagggctggttcagacaccattattgtgagcagcaaagcacttttctagtggtctgtttgtgagcctttcacttgtttgttccccacccccaaacctttgctgttaataaagtcaacttctctttacttcccctcccagcccctatgatgtcattcagcccagcacatacctcccgcaacccccaggtgctcaaggatcttggcttgaggcttagaaacacaggccagaggcagggccaatggtttcccacaaaatgtagcacaacgaaggtcagaattcgttttttttgtttgttttttttttttccaaaataagcccagaccattaaacaagtgaaactccaac

SEQ ID NO: 355182 - DNA, 2278 bp, Homo sapiens
ggaaacatcccgtccccgaccgcacccgcccgaagctgggtcaaggagcccagcaggacgggagcgcggcgcccccgacgcccgggaactggctcccccggttcccatctggtgacctcacctggtcccaccctttcaggtgaacggccaggcccggtgacgtcacttcctgccagaagcacctctctccctcgctccgcccttcacccagacgctcgccaatccgtgtgtggttccgagccggacttcatttccccgaaggcgtcgcggcctgaggagacccgttgggtcctcagcgtcttggcggcagttggtggaaccggagcttcgagtccgtccccggtgctgcctgcgcgttcacctgagtctcgctggagctcttctcgcccgcccacctcatctcaacccactttccgcggggagcggcgccaagctgggccttcctcggatcaggcgtcccctgaagtcggcacgcccctctgcgtcccccttcggtcccgctaggaccccgtccgggctgccgtcgcctcgtcgctatggcgcccaccatccagacccaggcccagcgggaggatggccacaggcccaattcccaccggactctgcctgagaggtctggagtggtctgccgagtcaagtactgcaatagcctccctgatatccccttcgaccccaagttcatcacctaccccttcgaccagaacaggttcgtccagtacaaagccacttccttggagaaacagcacaaacatgacctcctgactgagccagacctgggggtcaccatcgatctcatcaatcctgacacctaccgcatcgaccccaatgttcttctagatccagctgatgagaaacttttggaagaggagattcaggcccccaccagctccaagagatcccagcagcacgcgaaggtggtgccatggatgcgaaagacagagtacatctccactgagttcaaccgttatggcatctccaatgagaagcctgaggtcaagattggggtttctgtgaagcagcagtttaccgaggaagaaatatacaaagacagggatagccagatcacagccattgagaagacttttgaggatgcccagaaatcaatctcacagcattacagcaaaccccgagtcacaccggtggaggtcatgcctgtcttcccagactttaagatgtggatcaatccatgtgctcaggtgatctttgactcagacccagcccccaaggacacgagtggtgcagctgcgttggagatgatgtctcaggccatgattaggggcatgatggatgaggaagggaaccagtttgtggcctatttcctgcctgtagaagagacgttgaagaaacgaaagcgggaccaggaggaggagatggactatgcaccagatgatgtgtatgactacaaaattgctcgggagtacaactggaacgtgaagaacaaagctagcaagggctatgaggaaaactacttcttcatcttccgagagggtgacggggtttactacaatgagttggaaaccagggtccgccttagtaagcgccgggccaaggctggggttcagtcaggcaccaacgccctgcttgtggtcaaacatcgggacatgaatgagaaggaactggaagctcaggaggcacggaaggcccagctagaaaaccacgaaccggaggaggaagaggaagaggagatggagacagaagagaaagaagctgggggctcagatgaggagcaggagaagggcagcagcagtgagaaggagggcagtgaagatgagcactcgggcagcgagagtgaacgggaggaaggtgacagggacgaggccagtgacaagagtggcagtggtgaggacgagagcagcgaggatgaggcccgggctgcccgtgacaaagaggagatctttggcagtgatgctgattctgaggacgatgccgactctgatgatgaggacagaggacaggcccaaggtggcagtgacaatgattcagacagcggcagcaatgggggtggccagcggagccggagccacagccgcagcgccagtcccttccccagtggcagcgagcactcggcccaggaggatggcagtgaagctgcagcttctgattccagtgaagctgatagtgacagtgactgagtcccagggcattcagggctggttcagacaccattattgtgagcagcaaagcacttttctagtggtctgtttgtgagcctttcacttgtttgttccccacccccaaacctttgctgtttcaaaccagggtaccgagctcgaattct

SEQ ID NO: 355183 - DNA, 2569 bp, Homo sapiens
ggaaacatcccgtccccgaccgcacccgcccgaagctgggtcaaggagcccagcaggacgggagcgcggcgcccccgacgcccgggaactggctcccccggttcccatctggtgacctcacctggtcccaccctttcaggtgaacggccaggcccggtgacgtcacttcctgccagaagcacctctctccctcgctccgcccttcacccagacgctcgccaatccgtgtgtggttccgagccggacttcatttccccgaaggcgtcgcggcctgaggagacccgttgggtcctcagcgtcttggcggcagttggtggaaccggagcttcgagtccgtccccggtgctgcctgcgcgttcacctgagtctcgctggagctcttctcgcccgcccacctcatctcaacccactttccgcggggagcggcgccaagctgggccttcctcggatcaggcgtcccctgaagtcggcacgcccctctgcgtcccccttcggtcccgctaggaccccgtccgggctgccgtcgcctcgtcgctatggcgcccaccatccagacccaggcccagcgggaggatggccacaggcccaattcccaccggactctgcctgagaggtctggagtggtctgccgagtcaagtactgcaatagcctccctgatatccccttcgaccccaagttcatcacctaccccttcgaccagaacaggttcgtccagtacaaagccacttccttggagaaacagcacaaacatgacctcctgactgagccagacctgggggtcaccatcgatctcatcaatcctgacacctaccgcatcgaccccaatgttcttctagatccagctgatgagaaacttttggaagaggagattcaggcccccaccagctccaagagatcccagcagcacgcgaaggtggtgccatggatgcgaaagacagagtacatctccactgagttcaaccgttatggcatctccaatgagaagcctgaggtcaagattggggtttctgtgaagcagcagtttaccgaggaagaaatatacaaagacagggatagccagatcacagccattgagaagacttttgaggatgcccagaaatcaatctcacagcattacagcaaaccccgagtcacaccggtggaggtcatgcctgtcttcccagactttaagatgtggatcaatccatgtgctcaggtgatctttgactcagacccagcccccaaggacacgagtggtgcagctgcgttggagatgatgtctcaggccatgattaggggcatgatggatgaggaagggaaccagtttgtggcctatttcctgcctgtagaagagacgttgaagaaacgaaagcgggaccaggaggaggagatggactatgcaccagatgatgtgtatgactacaaaattgctcgggagtacaactggaacgtgaagaacaaagctagcaagggctatgaggaaaactacttcttcatcttccgagagggtgacggggtttactacaatgagttggaaaccagggtccgccttagtaagcgccgggccaaggctggggttcagtcaggcaccaacgccctgcttgtggtcaaacatcgggacatgaatgagaaggaactggaagctcaggaggcacggaaggcccagctagaaaaccacgaaccggaggaggaagaggaagaggagatggagacagaagagaaagaagctgggggctcaggtaaatctggacaggccagactctgggagccctgggagggtggaaaagtgggtttcatctctctccactcccttccagatgaggagcaggagaagggcagcagcagtgagaaggagggcagtgaagatgagcactcgggcagcgagagtgaacgggaggaaggtgacagggacgaggccagtgacaagagtggcagtggtgaggacgagagcagcgaggatgaggcccgggctgcccgtgacaaagaggagatctttggcagtgatgctgattctgaggacgatgccgactctgatgatgaggacagaggacaggcccaaggtggcagtgacaatgattcagacagcggcagcaatgggggtggccagcggagccggagccacagccgcagcgccagtcccttccccagtggcagcgagcactcggcccaggaggatggcagtgaagctgcagcttctgattccagtgaagctgatagtgacagtgactgagtcccagggcattcagggctggttcagacaccattattgtgagcagcaaagcacttttctagtggtctgtttgtgagcctttcacttgtttgttccccacccccaaacctttgctgttaataaagtcaacttctctttacttcccctcccagcccctatgatgtcattcagcccagcacatacctcccgcaacccccaggtgctcaaggatcttggcttgaggcttagaaacacaggccagaggcagggccaatggtttcccacaaaatgtagcacaacgaaggtcagaattcgttttttttgtttgttttttttttttccaaaataagcccagaccattaaacaagtgaaactccaac

SEQ ID NO: 355184 - DNA, 2652 bp, Homo sapiens
ggaaacatcccgtccccgaccgcacccgcccgaagctgggtcaaggagcccagcaggacgggagcgcggcgcccccgacgcccgggaactggctcccccggttcccatctggtgacctcacctggtcccaccctttcaggtgaacggccaggcccggtgacgtcacttcctgccagaagcacctctctccctcgctccgcccttcacccagacgctcgccaatccgtgtgtggttccgagccggacttcatttccccgaaggcgtcgcggcctgaggagacccgttgggtcctcagcgtcttggcggcagttggtggaaccggagcttcgagtccgtccccggtgctgcctgcgcgttcacctgagtctcgctggagctcttctcgcccgcccacctcatctcaacccactttccgcggggagcggcgccaagctgggccttcctcggatcaggcgtcccctgaagtcggcacgcccctctgcgtcccccttcggtcccgctaggaccccgtccgggctgccgtcgcctcgtcgctatggcgcccaccatccagacccaggcccagcgggaggatggccacaggcccaattcccaccggactctgcctgagaggtctggagtggtctgccgagtcaagtactgcaatagcctccctgatatccccttcgaccccaagttcatcacctaccccttcgaccagaacaggttcgtccagtacaaagccacttccttggagaaacagcacaaacatgacctcctgactgagccagacctgggggtcaccatcgatctcatcaatcctgacacctaccgcatcgaccccaatgttcttctagatccagctgatgagaaacttttggaagaggagattcaggcccccaccagctccaagagatcccagcagcacgcgaaggtggtgccatggatgcgaaagacagagtacatctccactgagttcaaccgttatggcatctccaatgagaagcctgaggtcaagattggggtttctgtgaagcagcagtttaccgaggaagaaatatacaaagacagggatagccagatcacagccattgagaagacttttgaggatgcccagaaatcaatctcacagcattacagcaaaccccgagtcacaccggtggaggtcatgcctgtcttcccagactttaagatgtggatcaatccatgtgctcaggtgatctttgactcagacccagcccccaaggacacgagtggtgcagctgcgttggagatgatgtctcaggccatgattaggggcatgatggatgaggaagggaaccagtttgtggcctatttcctgcctgtagaagagacgttgaagaaacgaaagcgggaccaggaggaggagatggactatgcaccagatgatgtgtatgactacaaaattgctcgggagtacaactggaacgtgaagaacaaagctagcaagggctatgaggaaaactacttcttcatcttccgagagggtgacggggtttactacaatgagttggaaaccagggtccgccttagtaagcgccgggccaaggctggggttcagtcaggcaccaacgccctgcttgtggtcaaacatcgggacatgaatgagaaggaactggaagctcaggaggcaccggacaggcccagcctagaaaaccacgcaaccgggaggcacggacacgaagcgacgcaggaccacgcgagaccgacgcagcacaagcacagccggcgcgcgcctcaaaactcgaggagccaggcacaaccgcgccacgcacccccgctgacacaaggacggcacgctgacaccactgagccaacatccgaggcccagcgcaagagctcgaacggccgcacggaacaggctgaacccggggcaccgacgggccccgctgaacaaaaccaagtgggcccacctgcgccgacgccgacggacgaagcacaccgaacccgactcgacaggcccagcgcgcctgcccaggtcgcaccacacccgaagcgcccacccccctctcgcgcaccgcagatggcctcgcacttcccagcacgcgaacgcatccgcccaaagtccacgcaccggaccggagggcacacgcaccgcaccagggccccaaccggcagcggaacgccgaaccactcgaacatccacgaagaccgagcgacagacgcacacgggcaggttggacacacagcaggaaaagcccggcgcacacaccaaccaccggcaagcaggcccacggtccccacctcaccagcacgacggacccaccacgcagcccactcaagcgcccccaggcaaccgaataggccagcgccggaccagcctcgaaagaaccccatccgaaacaccaagccagaaacctcagaacacgaccgaaaagcgccacccgtagaagccacagccaagggcccatccccagggggcctagaggtcgagcaaaagaccaccattcaccgcaggacgcccaaggccacgggaacatcactgcacaagccgcgcaaccgagataggaggaagccccatacgcacacgtgcccacggacccccggcaccaccgcacaaccccttgcacaggccccaacacacaggccaccccctgcccttctcacacgcacaagagcaccaagcaaccccaacacaagcgcccagacaa

SEQ ID NO: 355185 - DNA, 1870 bp, Homo sapiens
tgctgtagcctgaatctagagtatacccccctggtgacttgcggtgtttccctcgggatacactctctggccccttcgaccaggagttcgtccagtacaaagccacttccttggagaaacagcacaaacatgacctcctgactgagccagacctgggggtcaccatcgatctcatcaatcctgacacctaccgcatcgaccccaatgttcttctagatccagctgatgagaaacttttggaagaggagattcaggcccccaccagctccaagagatcccagcagcacgcgaaggtggtgccatggatgcgaaagacagagtacatctccactgagttcaaccgttatggcatctccaatgagaagcctgaggtcaagattggggtttctgtgaagcagcagtttaccgaggaagaaatatacaaagacagggatagccagatcacagccattgagaagacttttgaggatgcccagaaatcaatctcacagcattacagcaaaccccgagtcacaccggtggaggtcatgcctgtcttcccagactttaagatgtggatcaatccatgtgctcaggtgatctttgactcagacccagcccccaaggacacgagtggtgcagctgcgttggagatgatgtctcaggccatgattaggggcatgatggatgaggaagggaaccagtttgtggcctatttcctgcctgtagaagagacgttgaagaaacgaaagcgggaccaggaggaggagatggactatgcaccagatgatgtgtatgactacaaaattgctcgggagtacaactggaacgtgaagaacaaagctagcaagggctatgaggaaaactacttcttcatcttccgagagggtgacggggtttactacaatgagttggaaaccagggtccgccttagtaagcgccgggccaaggctggggttcagtcaggcaccaacgccctgcttgtggtcaaacatcgggacatgaatgagaaggaactggaagctcaggaggcacggaaggcccagctagaaaaccacgaaccggaggaggaagaggaagaggagatggagacagaagagaaagaagctgggggctcagatgaggagcaggagaagggcagcagcagtgagaaggagggcagtgaagatgagcactcgggcagcgagagtgaacgggaggaaggtgacagggacgaggccagtgacaagagtggcagtggtgaggacgagagcagcgaggatgaggcccgggctgcccgtgacaaagaggagatctttggcagtgatgctgattctgaggacgatgccgactctgatgatgaggacagaggacaggcccaaggtggcagtgacaatgattcagacagcggcagcaatgggggtggccagcggagccggagccacagccgcagcgccagtcccttccccagtggcagcgagcactcggcccaggaggatggcagtgaagctgcagcttctgattccagtgaagctgatagtgacagtgactgagtcccagggcattcagggctggttcagacaccattattgtgagcagcaaagcacttttctagtggtctgtttgtgagcctttcacttgtttgttccccacccccaaacctttgctgttaataaagtcaacttctctttacttcccctcccagcccctatgatgtcattcagcccagcacatacctcccgcaacccccaggtgctcaaggatcttggcttgaggcttagaaacacaggccagaggcagggccaatggtttcccacaaaatgtagcacaacgaaggtcagaattcgttttttttgtttgttttttttttttccaaaataagcccagaccattaaacaagtgaaactccaac

SEQ ID NO: 355186 - DNA, 1761 bp, Homo sapiens
tgttctagaggataccagatcgtacgacagaggcagaccatgggggtaccagtcgactctcagtcaaatcctgacacctaccgcatcgacccccattgttcttctagatccagctgatgagaaacttttggaagaggagattcaggcccccaccagctccaagagatcccagcagcacgcgaaggtggtgccatggatgcgaaagacagagtacatctccactgagttcaaccgttatggcatctccaatgagaagcctgaggtcaagattggggtttctgtgaagcagcagtttaccgaggaagaaatatacaaagacagggatagccagatcacagccattgagaagacttttgaggatgcccagaaatcaatctcacagcattacagcaaaccccgagtcacaccggtggaggtcatgcctgtcttcccagactttaagatgtggatcaatccatgtgctcaggtgatctttgactcagacccagcccccaaggacacgagtggtgcagctgcgttggagatgatgtctcaggccatgattaggggcatgatggatgaggaagggaaccagtttgtggcctatttcctgcctgtagaagagacgttgaagaaacgaaagcgggaccaggaggaggagatggactatgcaccagatgatgtgtatgactacaaaattgctcgggagtacaactggaacgtgaagaacaaagctagcaagggctatgaggaaaactacttcttcatcttccgagagggtgacggggtttactacaatgagttggaaaccagggtccgccttagtaagcgccgggccaaggctggggttcagtcaggcaccaacgccctgcttgtggtcaaacatcgggacatgaatgagaaggaactggaagctcaggaggcacggaaggcccagctagaaaaccacgaaccggaggaggaagaggaagaggagatggagacagaagagaaagaagctgggggctcagatgaggagcaggagaagggcagcagcagtgagaaggagggcagtgaagatgagcactcgggcagcgagagtgaacgggaggaaggtgacagggacgaggccagtgacaagagtggcagtggtgaggacgagagcagcgaggatgaggcccgggctgcccgtgacaaagaggagatctttggcagtgatgctgattctgaggacgatgccgactctgatgatgaggacagaggacaggcccaaggtggcagtgacaatgattcagacagcggcagcaatgggggtggccagcggagccggagccacagccgcagcgccagtcccttccccagtggcagcgagcactcggcccaggaggatggcagtgaagctgcagcttctgattccagtgaagctgatagtgacagtgactgagtcccagggcattcagggctggttcagacaccattattgtgagcagcaaagcacttttctagtggtctgtttgtgagcctttcacttgtttgttccccacccccaaacctttgctgttaataaagtcaacttctctttacttcccctcccagcccctatgatgtcattcagcccagcacatacctcccgcaacccccaggtgctcaaggatcttggcttgaggcttagaaacacaggccagaggcagggccaatggtttcccacaaaatgtagcacaacgaaggtcagaattcgttttttttgtttgttttttttttttccaaaataagcccagaccattaaacaagtgaaactccaac

SEQ ID NO: 355187 - DNA, 404 bp, Homo sapiens
ctcaggtatgagttccttgaaggcagggactgcttgtctcgttggctgctgtctgctcagggcctagcacagtacctaccctagcacatagtagtagctgctcaattgttaatggagcaagcagtgtccaagtcccttcccactggggagccagctttcagactctgccatgggggacacttcattctgagttcctccccagagaagctccgcctctgggaagcagggctgtgaggggtgaagctggaatccaaacaccacaataggtgtttccccacccaggtgttcgtccagtacaaagccacttccttggagaaacagcacaaacatgacctcctgactgagccagacctgggggtcaccatcgatctcatcaatcctgacacctaccgcatcgaccccaa

SEQ ID NO: 355188 - DNA, 486 bp, Homo sapiens
tgttctagaggataccagatcgtacgacagaggcagaccatgggggtaccagtcgactctcagtcaaatcctgacacctaccgcatcgacccccattgttcttctagatccagctgatgagaaacttttggaagaggagattcaggcccccaccagctccaagagatcccagcagcacgcgaaggtggtgccatggatgcgaaagacagagtacatctccactgagttcaaccgttatggcatctccaatgagaagcctgaggtcaagattggggtttctgtgaagcagcagtttaccgaggaagaaatatacaaagacagggatagccagatcacagccattgagaagacttttgaggatgcccagaaatcaatctcacagcattacagcaaaccccgagtcacaccggtggaggtcatgcctgtcttcccagactttaagatgtggatcaatccatgtgctcaggagctcagtcgaacggactg

SEQ ID NO: 355189 - DNA, 2180 bp, Homo sapiens
aattaggctaggtacgaggcctggtgttgcggtgctgcctgcgcgttcacctgagtctcgctggagctcttctcgcccgcccacctcatctcaacccactttccgcggggagcggcgccaagctgggccttcctcggatcaggcgtcccctgaagtcggcacgcccctctgcgtcccccttcggtcccgctaggaccccgtccgggctgccgtcgcctcgtcgctatggcgcccaccatccagacccaggcccagcgggaggatggccacaggcccaattcccaccggactctgcctgagaggtctggagtggtctgccgagtcaagtactgcaatagcctccctgatatccccttcgaccccaagttcatcacctaccccttcgaccagaacaggttcgtccagtacaaagccacttccttggagaaacagcacaaacatgacctcctgactgagccagacctgggggtcaccatcgatctcatcaatcctgacacctaccgcatcgaccccaatgttcttctagatccagctgatgagaaacttttggaagaggagattcaggcccccaccagctccaagagatcccagcagcacgcgaaggtggtgccatggatgcgaaagacagagtacatctccactgagttcaaccgttatggcatctccaatgagaagcctgaggtcaagattggggtttctgtgaagcagcagtttaccgaggaagaaatatacaaagacagggatagccagatcacagccattgagaagacttttgaggatgcccagaaatcaatctcacagcattacagcaaaccccgagtcacaccggtggaggtcatgcctgtcttcccagactttaagatgtggatcaatccatgtgctcaggtgatctttgactcagacccagcccccaaggacacgagtggtgcagctgcgttggagatgatgtctcaggccatgattaggggcatgatggatgaggaagggaaccagtttgtggcctatttcctgcctgtagaagagacgttgaagaaacgaaagcgggaccaggaggaggagatggactatgcaccagatgatgtgtatgactacaaaattgctcgggagtacaactggaacgtgaagaacaaagctagcaagggctatgaggaaaactacttcttcatcttccgagagggtgacggggtttactacaatgagttggaaaccagggtccgccttagtaagcgccgggccaaggctggggttcagtcaggcaccaacgccctgcttgtggtcaaacatcgggacatgaatgagaaggaactggaagctcaggaggcacggaaggcccagctagaaaaccacgaaccggaggaggaagaggaagaggagatggagacagaagagaaagaagctgggggctcagatgaggagcaggagaagggcagcagcagtgagaaggagggcagtgaagatgagcactcgggcagcgagagtgaacgggaggaaggtgacagggacgaggccagtgacaagagtggcagtggtgaggacgagagcagcgaggatgaggcccgggctgcccgtgacaaagaggagatctttggcagtgatgctgattctgaggacgatgccgactctgatgatgaggacagaggacaggcccaaggtggcagtgacaatgattcagacagcggcagcaatgggggtggccagcggagccggagccacagccgcagcgccagtcccttccccagtggcagcgagcactcggcccaggaggatggcagtgaagctgcagcttctgattccagtgaagctgatagtgacagtgactgagtcccagggcattcagggctggttcagacaccattattgtgagcagcaaagcacttttctagtggtctgtttgtgagcctttcacttgtttgttccccacccccaaacctttgctgttaataaagtcaacttctctttacttcccctcccagcccctatgatgtcattcagcccagcacatacctcccgcaacccccaggtgctcaaggatcttggcttgaggcttagaaacacaggccagaggcagggccaatggtttcccacaaaatgtagcacaacgaaggtcagaattcgttttttttgtttgttttttttttttccaaaataagcccagaccattaaacaagtgaaactccaac

SEQ ID NO: 355190 - DNA, 2572 bp, Homo sapiens
ggaaacatcccgtccccgaccgcacccgcccgaagctgggtcaaggagcccagcaggacgggagcgcggcgcccccgacgcccgggaactggctcccccggttcccatctggtgacctcacctggtcccaccctttcaggtgaacggccaggcccggtgacgtcacttcctgccagaagcacctctctccctcgctccgcccttcacccagacgctcgccaatccgtgtgtggttccgagccggacttcatttccccgaaggcgtcgcggcctgaggagacccgttgggtcctcagcgtcttggcggcagttggtggaaccggagcttcgagtccgtccccggtgctgcctgcgcgttcacctgagtctcgctggagctcttctcgcccgcccacctcatctcaacccactttccgcggggagcggcgccaagctgggccttcctcggatcaggcgtcccctgaagtcggcacgcccctctgcgtcccccttcggtcccgctaggaccccgtccgggctgccgtcgcctcgtcgctatggcgcccaccatccagacccaggcccagcgggaggatggccacaggcccaattcccaccggactctgcctgagaggtctggagtggtctgccgagtcaagtactgcaatagcctccctgatatccccttcgaccccaagttcatcacctaccccttcgaccagaacaggttcgtccagtacaaagccacttccttggagaaacagcacaaacatgacctcctgactgagccagacctgggggtcaccatcgatctcatcaatcctgacacctaccgcatcgaccccaatgttcttctagatccagctgatgagaaacttttggaagaggagattcaggcccccaccagctccaagagatcccagcagcacgcgaaggtggtgccatggatgcgaaagacagagtacatctccactgagttcaaccgttatggcatctccaatgagaagcctgaggtcaagattggggtttctgtgaagcagcagtttaccgaggaagaaatatacaaagacagggatagccagatcacagccattgagaagacttttgaggatgcccagaaatcaatctcacagcattacagcaaaccccgagtcacaccggtggaggtcatgcctgtcttcccagactttaaggtcaggcccaaggtgggaggtagaaagggacagcctatttgtgcctgttcccatctaaccccagtgcctccatctccctagatgtggatcaatccatgtgctcaggtgatctttgactcagacccagcccccaaggacacgagtggtgcagctgcgttggagatgatgtctcaggccatgattaggggcatgatggatgaggaagggaaccagtttgtggcctatttcctgcctgtagaagagacgttgaagaaacgaaagcgggaccaggaggaggagatggactatgcaccagatgatgtgtatgactacaaaattgctcgggagtacaactggaacgtgaagaacaaagctagcaagggctatgaggaaaactacttcttcatcttccgagagggtgacggggtttactacaatgagttggaaaccagggtccgccttagtaagcgccgggccaaggctggggttcagtcaggcaccaacgccctgcttgtggtcaaacatcgggacatgaatgagaaggaactggaagctcaggaggcacggaaggcccagctagaaaaccacgaaccggaggaggaagaggaagaggagatggagacagaagagaaagaagctgggggctcagatgaggagcaggagaagggcagcagcagtgagaaggagggcagtgaagatgagcactcgggcagcgagagtgaacgggaggaaggtgacagggacgaggccagtgacaagagtggcagtggtgaggacgagagcagcgaggatgaggcccgggctgcccgtgacaaagaggagatctttggcagtgatgctgattctgaggacgatgccgactctgatgatgaggacagaggacaggcccaaggtggcagtgacaatgattcagacagcggcagcaatgggggtggccagcggagccggagccacagccgcagcgccagtcccttccccagtggcagcgagcactcggcccaggaggatggcagtgaagctgcagcttctgattccagtgaagctgatagtgacagtgactgagtcccagggcattcagggctggttcagacaccattattgtgagcagcaaagcacttttctagtggtctgtttgtgagcctttcacttgtttgttccccacccccaaacctttgctgttaataaagtcaacttctctttacttcccctcccagcccctatgatgtcattcagcccagcacatacctcccgcaacccccaggtgctcaaggatcttggcttgaggcttagaaacacaggccagaggcagggccaatggtttcccacaaaatgtagcacaacgaaggtcagaattcgttttttttgtttgttttttttttttccaaaataagcccagaccattaaacaagtgaaactccaac

SEQ ID NO: 355191 - DNA, 2369 bp, Homo sapiens
ggaaacatcccgtccccgaccgcacccgcccgaagctgggtcaaggagcccagcaggacgggagcgcggcgcccccgacgcccgggaactggctcccccggttcccatctggtgacctcacctggtcccaccctttcaggtgaacggccaggcccggtgacgtcacttcctgccagaagcacctctctccctcgctccgcccttcacccagacgctcgccaatccgtgtgtggttccgagccggacttcatttccccgaaggcgtcgcggcctgaggagacccgttgggtcctcagcgtcttggcggcagttggtggaaccggagcttcgagtccgtccccggtgctgcctgcgcgttcacctgagtctcgctggagctcttctcgcccgcccacctcatctcaacccactttccgcggggagcggcgccaagctgggccttcctcggatcaggcgtcccctgaagtcggcacgcccctctgcgtcccccttcggtcccgctaggaccccgtccgggctgccgtcgcctcgtcgctatggcgcccaccatccagacccaggcccagcgggaggatggccacaggcccaattcccaccggactctgcctgagaggtctggagtggtctgccgagtcaagtactgcaatagcctccctgatatccccttcgaccccaagttcatcacctaccccttcgaccagaacagttcttctagatccagctgatgagaaacttttggaagaggagattcaggcccccaccagctccaagagatcccagcagcacgcgaaggtggtgccatggatgcgaaagacagagtacatctccactgagttcaaccgttatggcatctccaatgagaagcctgaggtcaagattggggtttctgtgaagcagcagtttaccgaggaagaaatatacaaagacagggatagccagatcacagccattgagaagacttttgaggatgcccagaaatcaatctcacagcattacagcaaaccccgagtcacaccggtggaggtcatgcctgtcttcccagactttaagatgtggatcaatccatgtgctcaggtgatctttgactcagacccagcccccaaggacacgagtggtgcagctgcgttggagatgatgtctcaggccatgattaggggcatgatggatgaggaagggaaccagtttgtggcctatttcctgcctgtagaagagacgttgaagaaacgaaagcgggaccaggaggaggagatggactatgcaccagatgatgtgtatgactacaaaattgctcgggagtacaactggaacgtgaagaacaaagctagcaagggctatgaggaaaactacttcttcatcttccgagagggtgacggggtttactacaatgagttggaaaccagggtccgccttagtaagcgccgggccaaggctggggttcagtcaggcaccaacgccctgcttgtggtcaaacatcgggacatgaatgagaaggaactggaagctcaggaggcacggaaggcccagctagaaaaccacgaaccggaggaggaagaggaagaggagatggagacagaagagaaagaagctgggggctcagatgaggagcaggagaagggcagcagcagtgagaaggagggcagtgaagatgagcactcgggcagcgagagtgaacgggaggaaggtgacagggacgaggccagtgacaagagtggcagtggtgaggacgagagcagcgaggatgaggcccgggctgcccgtgacaaagaggagatctttggcagtgatgctgattctgaggacgatgccgactctgatgatgaggacagaggacaggcccaaggtggcagtgacaatgattcagacagcggcagcaatgggggtggccagcggagccggagccacagccgcagcgccagtcccttccccagtggcagcgagcactcggcccaggaggatggcagtgaagctgcagcttctgattccagtgaagctgatagtgacagtgactgagtcccagggcattcagggctggttcagacaccattattgtgagcagcaaagcacttttctagtggtctgtttgtgagcctttcacttgtttgttccccacccccaaacctttgctgttaataaagtcaacttctctttacttcccctcccagcccctatgatgtcattcagcccagcacatacctcccgcaacccccaggtgctcaaggatcttggcttgaggcttagaaacacaggccagaggcagggccaatggtttcccacaaaatgtagcacaacgaaggtcagaattcgttttttttgtttgttttttttttttccaaaataagcccagaccattaaacaagtgaaactccaac

SEQ ID NO: 355192 - DNA, 1281 bp, Homo sapiens
ctcccactatgaggaggtactgacgcagctacgccacgtactggagcggcagaacaatgaataccaagtgctgctgggcatctatacccacctggagaaggaaatcaccacgtaccgacggctcctggagggagagagtgaagggacacgggaagaggagatggactatgcaccagatgatgtgtatgactacaaaattgctcgggagtacaactggaacgtgaagaacaaagctagcaagggctatgaggaaaactacttcttcatcttccgagagggtgacggggtttactacaatgagttggaaaccagggtccgccttagtaagcgccgggccaaggctggggttcagtcaggcaccaacgccctgcttgtggtcaaacatcgggacatgaatgagaaggaactggaagctcaggaggcacggaaggcccagctagaaaaccacgaaccggaggaggaagaggaagaggagatggagacagaagagaaagaagctgggggctcagatgaggagcaggagaagggcagcagcagtgagaaggagggcagtgaagatgagcactcgggcagcgagagtgaacgggaggaaggtgacagggacgaggccagtgacaagagtggcagtggtgaggacgagagcagcgaggatgaggcccgggctgcccgtgacaaagaggagatctttggcagtgatgctgattctgaggacgatgccgactctgatgatgaggacagaggacaggcccaaggtggcagtgacaatgattcagacagcggcagcaatgggggtggccagcggagccggagccacagccgcagcgccagtcccttccccagtggcagcgagcactcggcccaggaggatggcagtgaagctgcagcttctgattccagtgaagctgatagtgacagtgactgagtcccagggcattcagggctggttcagacaccattattgtgagcagcaaagcacttttctagtggtctgtttgtgagcctttcacttgtttgttccccacccccaaacctttgctgttaataaagtcaacttctctttacttcccctcccagcccctatgatgtcattcagcccagcacatacctcccgcaacccccaggtgctcaaggatcttggcttgaggcttagaaacacaggccagaggcagggccaatggtttcccacaaaatgtagcacaacgaaggtcagaattcgttttttttgtttgttttttttttttccaaaataagcccagaccattaaacaagtgaaactccaac

SEQ ID NO: 355193 - DNA, 408 bp, Homo sapiens
agaggggatgagaggatgaaacaaggatgcagaagcaagatgtcaattgaaagataactctcaggtcaggtatggtggctcggtggttcatgcctgtaatcccagcactttgggagaccaaggagggaggatctcttgaagctaggagttggagaccagcctgggcaaagcaagaatccccgcccccgccgcccactccttgtctctacaaaaataaaaaattaaaccaggtgtggtggcatgcacctatagtcctagctacccaaggaggctgaggcaggaggatcgcttgagcccaggagcttgaggttggagtgagctatgttcaagccactgcaccacagcctgggtgagcctgggtgagcctgagtgagcctgggtgagccaaaccccaacaacaacaacaac

SEQ ID NO: 355194 - DNA, 422 bp, Homo sapiens
tattcataaaacctccaggcatcctctgaggacgcctcacgcaggagaaagctgctagttccctttggctctcttgccctttggttatatctgcccctgccgggggtagggatgtggggcttgggggcatctcctgtggtgtgcctggggtgtgcagcccctgattgtcgttgtggtgcccatcaggaccctggacagaagaagggaggactcagtgccagggcaatagggaggccccccagggacgctagtgctgtgacatgcgcctgtcttctccctctgaccccagagaaaggggctgtggtcagctgggatcttctgccaccatcagggacaaacgggggcaggaggaaagtcactgatgcccagatgtttgcatcctgcacagctacaggtccttaaataaaagtgtgctgttggtt

SEQ ID NO: 355195 - DNA, 4208 bp, Homo sapiens
agcgggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagggcgccttctgatgccacctccagccgccatccaccagacgccagcttccccgctgccctgaacttcctccagcgcaccaggccttcctctgtcctgtctgaggatttgctcatgcaacgtgctgtggccaaacaccctgccctcctcccttggcagatgtcttcctctcctttaaggcctggctcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgcgtggacatgcagagaagcaggcacgagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatcgaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtgttttcggcccctccctggctcttaccaggtcacgtgatccctccagacaacatcctgccccttgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaaccagtccataggcagggccatcaggcaccagaaggattttgccagcatagtgctcctggaccagcgatatgcccggccccctgtcctggccaagctgccggcctggatccgagcccgtgtggaggtcaaagctacctttggccccgccattgctgctgtgcagaaggtcagtcctacctttttctttctgagagcctccccaccccgagatcacatttctcactgccttctgtctgcccagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgccccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctacaggtccttaaataaaagtgtgctgttggtt

SEQ ID NO: 355196 - DNA, 1830 bp, Homo sapiens
tttgctgagtttgctgagggaagactgttttctgttctctctctcacacacagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcaggtaaacagtagccagtatttccaccaggggccatcctgctcctttcgccacaactttgtcctgctcgtccaggccttgggagacgctgggtctgtgacaggctgaaccgtgtgaggagcagccccctccctgacctggccggcccagcactggaaggcaaaggagaggtggcggggcaggtccacatgtgttggtaggatgtcatttagctggcaccatctttttgcctctttctttctcctttgctgcagaacctttgtgtaaatgaagacgtgaaaagcctaggttctgtgcagcttatcaacgaccgctgcgtggacatgcagagaagcaggcacgcggtagccactgggaccgtggtgtagccgcaggtggtctggagagagtgaggcaggggtggcagtgactgaagaccattaagtgtctttcatagaaagaatggcagaggagaccccagttccttcctgagtcccctctccttgggaaaaagtgttcctactctctgggtcagtgtctggtccgaatccttggcttggagatgattttacgggctctttctggagaacagaagtaaaaccttacagtgttccgatgagaccacagtaggcagtacttgggagggtcttatagaccccaccccacggaagtgggtctcaacattacacaaccccctcttgggcccgtggacagttgctgtcctctctgttttctctctttgtgcctgtgccaccctcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctagggggtgagagcctcgtccccctgctgaccccgggcctgcaaaactcgctgggctgctttttccttggatgcccatcaggacacctcagttctctgtgtttttaagaagggtcggccgggtgcggtggctcacgcctgtaatcccagcacttgggaggccgaggcaggtggttcacctgaggttaggagttttgagaccagcctggccaacatggtgaaatcccatctctactaaaaatacaaaaaaattagctgggagtgttgccgtggcctgtagtcccagctgctccagaggctgagacaagagaattgcttgctcaaacccgggaggcggaggttgcagtgagccgagattgtgccactgcagtccagtctgggcgacagagtgagaatcagtctcaa

SEQ ID NO: 355197 - DNA, 4160 bp, Homo sapiens
  misc_feature (3934)..(3934): n is a, c, g, or t
agcgggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgcgtggacatgcagagaagcaggcacgagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatcgaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtggtcacgtgatccctccagacaacatcctgccccttgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaaccagtccataggcagggccatcaggcaccagaaggattttgccagcatagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgccccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctacaggtccttaaataaaagtgtgctgttggttaaaaaaaaaaaaaaaanattccccctttggagaggcccgttacccattaccgcccatagtgatacaaattccaatccactgacacccggttgaaaccgccgtgactggaaatccctggggtcccccatttaaaacgcgtgtgagaaataacatcttcgccacgtgggtaataacaaaaaggcccaacccgacggcctaccgacatgtcagcctgttcgattagtgggacgccttatgtttgct

SEQ ID NO: 355198 - DNA, 3750 bp, Homo sapiens
agcgggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatcgaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtggtcacgtgatccctccagacaacatcctgccccttgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctcgcagggccatcaggcaccagaaggattttgccagcatagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgccccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctacaggtccttaaataaaagtgtgctgttggtt

SEQ ID NO: 355199 - DNA, 3732 bp, Homo sapiens
ggcatcatccattctctctgcccaagttgctctgtatgtgttcgtcagtggcagagcaggctaggagggtgagcagcagccatctccagccaccttgagttccttcctgccttcactctaagttgagcagctccacgtcaaagatgagggtggcattgggagggatgacaccggggtggcccgtggctccatatgccacatcaggggtgcaggtcagcttcgccctctgccccaagctcatctgggctgcaccctcttcaaaacctttgatgacttcctctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatcgaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtggtcacgtgatccctccagacaacatcctgccccttgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctcgcagggccatcaggcaccagaaggattttgccagcatagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgccccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctacaggtccttaaataaaagtgtgctgttggtt

SEQ ID NO: 355200 - DNA, 4181 bp, Homo sapiens
  misc_feature (3870)..(3870): n is a, c, g, or t
  misc_feature (3880)..(3880): n is a, c, g, or t
  misc_feature (3898)..(3898): n is a, c, g, or t
  misc_feature (3911)..(3911): n is a, c, g, or t
agcgggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgcgtggacatgcagagaagcaggcacgagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatcgaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtggtcacgtgatccctccagacaacatcctgccccttgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaaccagtccataggcagggccatcaggcaccagaaggattttgccagcatagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgccccacagccctgcctggatttgtatccttggcttcgtgccagttcctccaagtctatggcacctccctccctctcaaccacttgagcaaactccaagacaccttctaccccaacaccagcaattatgccggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctacaggtccttaaataaaagtgtgctgttggttnaaaaaaaaanaattcaatttacaaaatnacctttaggggtntcctttcgctattccccgtctgggggggacaacctcgggggggccgttccaatttcccttagggggcgcttacattcacggccgtgtttaaacacgtgctggaaaccacggggtacaaataaaggccttgacacagcctcttaagcgatggcgtattgtgaaagcccaaacggcgccttcaaaaggtggcccctaggggatggcaaataacctttttttttttgactccgggaaatttgtacctattttacccaggccccggttcctttt

SEQ ID NO: 355201 - DNA, 3753 bp, Homo sapiens
agcgggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgcgtggacatgcagagaagcaggcacgagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatcgaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtggtcacgtgatccctccagacaacatcctgccccttgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggcagggccatcaggcaccagaaggattttgccagcatagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgccccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctacaggtccttaaataaaagtgtgctgttggtt

SEQ ID NO: 355202 - DNA, 4072 bp, Homo sapiens
agcgggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgcgtggacatgcagagaagcaggcacgagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatcgaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtggtgagaagctgtgcccagggtggggcaggctagaggtcaggttctggcccccgttttctgtgggtaatacctcatactgcgaccaggcacaggggcggaggagaccccggggtgggagcctcacccttcgtgcgctcgcccaggctctcctgctttgctccctgctgcctgctgcccagtgtgactggtgatggtgggcgggtgagcgctgtcagtcgctgttcctgtgctggatgatggggcagggaaatgccctctctgcagtgtcttgcagcacacctgcatctccagttttcggcccctccctggctcttaccaggtcacgtgatccctccagacaacatcctgccccttgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggcagggccatcaggcaccagaaggattttgccagcatagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgccccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctacaggtccttaaataaaagtgtgctgttggtt

SEQ ID NO: 355203 - DNA, 2825 bp, Homo sapiens
agcgggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaaggaatgccgggcagtggtcattgcggggggtaccatgcagccggtgtctgacttccggcagcagctgctggcctgtgccggggtggaagctgagcgcgtggtggagttttcctgtggtcacgtgatccctccagacaacatcctgccccttgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaaccagtccataggcagggccatcaggcaccagaaggattttgccagcatagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgccccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctacaggtccttaaataaaagtgtgctgttggtt

SEQ ID NO: 355204 - DNA, 2178 bp, Homo sapiens
agcgggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggtgagacctggggtatccggaagcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggcagggccatcaggcaccagaaggattttgccagcatagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgccccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctacaggtccttaaataaaagtgtgctgttggtt

SEQ ID NO: 355205 - DNA, 2008 bp, Homo sapiens
agcgggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgcgtggacatgcagagaagcaggcacgagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctagggggtgagagcctcgtccccctgctgaccccgggcctgcaaaactcgctgggctgctttttccttggatgcccatcaggacacctcagttctctgtgtttttaagaagggtcggccgggtgcggtggctcacgcctgtaatcccagcacttgggaggccgaggcaggtggttcacctgaggttaggagttttgagaccagcctggccaacatggtgaaatcccatctctactaaaaatacaaaaaaattagctgggagtgttgccgtggcctgtagtcccagctgctccagaggctgagacaagagaattgcttgctcaaacccgggaggcggaggttgcagtgagccgagattgtgccactgcagtccagtctgggcgacagagtgagaatcagtctcaa

SEQ ID NO: 355206 - DNA, 401 bp, Homo sapiens
aaaaggatggagaggacagtgtggtccacctctgtgggctggttgtcctagagattaaatggtgtttaatttaaagagaaagcactagcacttgtgcctcagacctggactcacctgggggaccccctttgctgggacgacagaagtgtctgttgggcttgcactcacctcccaccgatctgtttttccaggcagcctcagtcagagcaccctgaagtttttgctcctgaatccagctgtgcactttgcccaagtggtgaaggaatgccgggcagtggtcattgcggggggtaccatgcagccggtaaggacacctttcccagcccctcgtgccccaggtgttgggatgagatgggggcttgggagagatgcattatcagtcctgttctctcctggggccc

SEQ ID NO: 355207 - DNA, 3917 bp, Homo sapiens
agcgggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgcgtggacatgcagagaagcaggcacgagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatcgaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtggtcacgtgatccctccagacaacatcctgccccttgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaaccagtccataggcagggccatcaggcaccagaaggattttgccagcatagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgccccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctacaggtccttaaataaaagtgtgctgttggtt

SEQ ID NO: 355208 - DNA, 3767 bp, Homo sapiens
agcgggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgcgtggacatgcagagaagcaggcacgagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatcgaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtggtcacgtgatccctccagacaacatcctgccccttgtcatctgcagcgggatctccaaccagccgctggaattcacgttccagaaaagagagctgcctcagatgatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaaccagtccataggcagggccatcaggcaccagaaggattttgccagcatagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgccccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctacaggtccttaaataaaagtgtgctgttggtt

SEQ ID NO: 355209 - DNA, 448 bp, Homo sapiens
ggttgggggtcctgagaaccagcattgtgacctatttccattctcttttttagggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaaggtaactgctcccatcttgtggtcctgaacaagacccagctgtgccccaaccccctgcccttgccatgctttcctcccctgccctcagggaactccagagtccccttcgtctccactctccttggtgcagtgggccttgctggggtggtgggatgtgtgctgcaggtgtcttgggcctggcagagcctccgatccacccagcctctctctcatggctgtacctcgttcctctccactgctctct

SEQ ID NO: 355210 - DNA, 3850 bp, Homo sapiens
  misc_feature (3847)..(3847): n is a, c, g, or t
agcgggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgcgtggacatgcagagaagcaggcacgagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatcgaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtggtcacgtgatccctccagacaacatcctgccccttgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaaccagtccataggcagggccatcaggcaccagaaggattttgccagcatagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgccccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacttcctcctgcccccgtntgt

SEQ ID NO: 355211 - DNA, 3555 bp, Homo sapiens
agcgggttgttccggctgcctttcactgaggggacccgccagtttctaactcagtggcgtttgccctgattcccggggcctggctttcagcgtagcaattctgccggcgaagaaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatcgaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtggtcacgtgatccctccagacaacatcctgccccttgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctcgcagggccatcaggcaccagaaggattttgccagcatagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgccccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctacaggtccttaaataaaagtgtgctgttggtt

SEQ ID NO: 355212 - DNA, 4565 bp, Homo sapiens
agcgggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcaggtaaacagtagccagtatttccaccaggggccatcctgctcctttcgccacaactttgtcctgctcgtccaggccttgggagacgctgggtctgtgacaggctgaaccgtgtgaggagcagccccctccctgacctggccggcccagcactggaaggcaaaggagaggtggcggggcaggtccacatgtgttggtaggatgtcatttagctggcaccatctttttgcctctttctttctcctttgctgcagaacctttgtgtaaatgaagacgtgaaaagcctaggttctgtgcagcttatcaacgaccgctgcgtggacatgcagagaagcaggcacgcggtagccactgggaccgtggtgtagccgcaggtggtctggagagagtgaggcaggggtggcagtgactgaagaccattaagtgtctttcatagaaagaatggcagaggagaccccagttccttcctgagtcccctctccttgggaaaaagtgttcctactctctgggtcagtgtctggtccgaatccttggcttggagatgattttacgggctctttctggagaacagaagtaaaaccttacagtgttccgatgagaccacagtaggcagtacttgggagggtcttatagaccccaccccacggaagtgggtctcaacattacacaaccccctcttgggcccgtggacagttgctgtcctctctgttttctctctttgtgcctgtgccaccctcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatcgaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtggtcacgtgatccctccagacaacatcctgccccttgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaaccagtccataggcagggccatcaggcaccagaaggattttgccagcatagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgccccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctacaggtccttaaataaaagtgtgctgttggtt

SEQ ID NO: 355213 - DNA, 2233 bp, Homo sapiens
  misc_feature (5)..(5): n is a, c, g, or t
  misc_feature (12)..(12): n is a, c, g, or t
  misc_feature (39)..(39): n is a, c, g, or t
ccggnccttatnccacgatcccaacatcaacctgtcaangtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatcgaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtggtcacgtgatccctccagacaacatcctgccccttgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaaccagtccataggcagggccatcaggcaccagaaggattttgccagcatagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgccccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctacaggtccttaaataaaagtgtgctgttggtt

SEQ ID NO: 355214 - DNA, 2630 bp, Homo sapiens
agcgggttgttccggctgcctttcactgaggggacccgccagtttctaactcagtggcgtttgccctgattcccggggcctggctttcagcgtagcaattctgccggcgaagaaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaaggaatgccgggcagtggtcattgcggggggtaccatgcagccggtgtctgacttccggcagcagctgctggcctgtgccggggtggaagctgagcgcgtggtggagttttcctgtggtcacgtgatccctccagacaacatcctgccccttgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaaccagtccataggcagggccatcaggcaccagaaggattttgccagcatagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgccccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctacaggtccttaaataaaagtgtgctgttggtt

SEQ ID NO: 355215 - DNA, 2635 bp, Homo sapiens
agcgggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgcgtggacatgcagagaagcaggcacgagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatcgaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtggtcacgtgatccctccagacaacatcctgccccttgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaaggtgagtggcctgtcggcagccttcccacttgtgaggacagtgccactgagtcctcctgggagctctcgtgctcatcgggtcaggacaggcttctggctcctcatccccaccgctcccagtccctgactacagaggatttcccccaaagtccctggctgtgaggttctccagtcccctggccagaaaacacaa

SEQ ID NO: 355216 - DNA, 1152 bp, Homo sapiens
ctaggccccgccccctgacccgcaccttcccgccgcccctccccggttccatttcattgttggattgtggcgcttcactcctgctggcggccggcagggggcggagttcgagcctggatttttttcctcggggcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcggacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaaggtgtccagggaatgtcacgtctaggacactttt

SEQ ID NO: 355217 - DNA, 797 bp, Homo sapiens
ctaggccccgccccctgacccgcaccttcccgccgcccctccccggttccatttcattgttggattgtggcgcttcactcctgctggcggccggcagggggcggagttcgagcctggatttttttcctcggggcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcgggataaataaagaaaacaggaaaggaggaaagcattgattacaaatgtcttaacaatgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtaggcaataggcaggcaccgttgaaagtcaaaatatatggaaatgagaattaggtgcagattctgttttcttgccattgatcttaaattttccatgttccctggttatcagccattcttgcttatttgattgtgaagaaaagatacgtgttgtaattagccttgcatttta

SEQ ID NO: 355218 - DNA, 839 bp, Homo sapiens
ctaggccccgccccctgacccgcaccttcccgccgcccctccccggttccatttcattgttggattgtggcgcttcactcctgctggcggccggcagggggcggagttcgagcctggatttttttcctcggggcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcgggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacactgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaaggtgtccagggaatgtcacgtctaggacactttt

SEQ ID NO: 355219 - DNA, 2822 bp, Homo sapiens
ctaggccccgccccctgacccgcaccttcccgccgcccctccccggttccatttcattgttggattgtggcgcttcactcctgctggcggccggcagggggcggagttcgagcctggatttttttcctcggggcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcggacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355220 - DNA, 2633 bp, Homo sapiens
ctaggccccgccccctgacccgcaccttcccgccgcccctccccggttccatttcattgttggattgtggcgcttcactcctgctggcggccggcagggggcggagttcgagcctggatttttttcctcggggcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcggacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacactgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355221 - DNA, 2565 bp, Homo sapiens
agcggagctacgggtcagagctagtccactaggtgctaatcaaatgctgtgttacaacactgtgaggttttcccagttataagtgtcactattagggttttttttaattgcaaagccaaataaggctgtcaattgcatcatcttaccttatttcttcagattaagtactgtttatagtgggatttttggtggatgtggtggcatcagcataatctatgtttcaggcgtcctatagaagaggattattcttcaggggatgtggaagaaaaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355222 - DNA, 2231 bp, Homo sapiens
ctaggccccgccccctgacccgcaccttcccgccgcccctccccggttccatttcattgttggattgtggcgcttcactcctgctggcggccggcagggggcggagttcgagcctggatttttttcctcggggcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcggacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacactgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355223 - DNA, 2004 bp, Homo sapiens
acatgcttgctaatttggaacactttatgttgaactgtggtagaggaaacaagacagttctgtctgcagaagcccattatggctgtaactggagatgacacagatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355224 - DNA, 2066 bp, Homo sapiens
tttgtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355225 - DNA, 2413 bp, Homo sapiens
agctgggaacattcttagccaccgaagtatgggcaccaaaagcgataaggagcatgtgttccttaataaatgtcacatcagaaaatgactgttccaggacagtaaccacctcccgatggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355226 - DNA, 2024 bp, Homo sapiens
ctggtacggtcggagttatgggatgcggagccgggtgcggtggagcagcagaggcgccccacgcccgcttcgtgcgctcagctgccccgggacccgcctgcctcctcgcgaacttgggacgagttggaaaatcctccctgagagagccgtgcggctcaggggagcggtttaactcggaaaaggaaaaggaatccagaagataaataaagaaaacaggaaaggaggaaagcattgattacaaatgtcttaacaatgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcagtgcagtgagctgagatcaggcaccagaagaggctccccagctgtaactctagtgcagttaccttcgggccaaactatacatgtccagggagtaattcagacaccacagccatgggttattcagtcatcagaaatacacaccgttcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtcttta

SEQ ID NO: 355227 - DNA, 2285 bp, Homo sapiens
ctggtacggtcggagttatgggatgcggagccgggtgcggtggagcagcagaggcgccccacgcccgcttcgtgcgctcagctgccccgggacccgcctgcctcctcgcgaacttgggacgagttggaaaatcctccctgagagagccgtgcggctcaggggagcggtttaactcggaaaaggaaaaggaatccagaagataaataaagaaaacaggaaaggaggaaagcattgattacaaatgtcttaacaatgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355228 - DNA, 2506 bp, Homo sapiens
tttgtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtggtaagatcgagcctcctactgaggccgtccctgcatgcgcctggtgagaaatggattatgtattgtataagctggcgggttctttactcttactccatcctcttactccatctataggaacttgcgattcagagctcctctagtgttcagtcagggaagtgcttgtcttttacttgttctcccagcctctggtatttaaatttgtaatcggtaatttttcactaggtttgcttttctcagtaacaaagagtgattttggaagacttagttactaataacctttgtgtgcttgcagtgttgtttattcagtggtcttgtttgtaatacagtactgaatttgcagttgaattaagagttttaaacaacttcactacaatttagctcttcgaagttaatgggtctcagccctctttgtggataggaacattggattgtcttgactgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355229 - DNA, 1816 bp, Homo sapiens
tacctaggatcgattggctgttgagttcggggggcagaagtgcactgacccactgtggattgtgttggaaggctgttcctgtagtcatttgccttgtgttgcttccagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355230 - DNA, 2162 bp, Homo sapiens
ttatttcgttttttttcccccccaccttcctgcgccgccgaaggcccttagtggcagtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacactgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355231 - DNA, 2026 bp, Homo sapiens
ctggtacggtcggagttatgggatgcggagccgggtgcggtggagcagcagaggcgccccacgcccgcttcgtgcgctcagctgccccgggacccgcctgcctcctcgcgaacttgggacgagttggaaaatcctccctgagagagccgtgcggctcaggggagcggtttaactcggaaaaggaaaaggaatccagaaacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacactgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355232 - DNA, 1665 bp, Homo sapiens
  misc_feature (42)..(42): n is a, c, g, or t
  misc_feature (50)..(50): n is a, c, g, or t
  misc_feature (67)..(67): n is a, c, g, or t
taggatggaaagcgacgtgatcacacttaccgagcttacttngatctgtntgtcaatagcatgcaanaaaatgctttgtttgccctttgcttctgcttttttttcagggaagctgccaaagaatgtcgacgtcgcctagcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355233 - DNA, 1770 bp, Homo sapiens
agctgggaacattcttagccaccgaagtatgggcaccaaaagcgataaggagcatgtgttccttaataaatgtcacatcagaaaatgactgttccaggacagtaaccacctcccgatgttgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355234 - DNA, 1664 bp, Homo sapiens
tttgtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355235 - DNA, 1707 bp, Homo sapiens
tttgtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtggtaagatcgagcctcctactgaggccgtccctgcatgcgcctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355236 - DNA, 1339 bp, Homo sapiens
ctaggccccgccccctgacccgcaccttcccgccgcccctccccggttccatttcattgttggattgtggcgcttcactcctgctggcggccggcagggggcggagttcgagcctggatttttttcctcggggcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcggacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacagtatgtatgctgcaattcgatatgatacagtgctagctttaagtcttctctagttatattgaagcaactcaggttttggcattaaattgttccattttaaaatgcatcattaatacctaaactgtatcatagaatgaaagtatatgttaaaaagtgagatctttgtattgacagctgtcatataattttgaaaagtaaaaattttgactgccgaatatagaagaaaattttggggtaaaaaggagaatttttcctatttacatgtttatattaatctctagtaaaacattgtttttgttgtctttatgatgcatgcgaacataaatgtctgtatttcattcttgttggcttttgttacccacaattacatactattcttactaatctgagagttttctaaagtatgttttcaatgtttcactactctctactctgttaatttgtgctacagtttttcctaaaagagaatggaaaaatgatttaattttttaaactgtagcaattggatagataattttatttgaaattttacacactgaaagctctaaataaacagatacattcacattca

SEQ ID NO: 355237 - DNA, 1566 bp, Homo sapiens
acatgcttgctaatttggaacactttatgttgaactgtggtagaggaaacaagacagttctgtctgcagaagcccattatggctgtaactggagatgacacagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355238 - DNA, 1821 bp, Homo sapiens
ctggtacggtcggagttatgggatgcggagccgggtgcggtggagcagcagaggcgccccacgcccgcttcgtgcgctcagctgccccgggacccgcctgcctcctcgcgaacttgggacgagttggaaaatcctccctgagagagccgtgcggctcaggggagcggtttaactcggaaaaggaaaaggaatccagaagataaataaagaaaacaggaaaggaggaaagcattgattacaaatgtcttaacaatgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcagtgcagtgagctgagatcaggcaccagaagaggctccccagctgtaactctagtgcagttaccttcgggccaaactatacatgtccagggagtaattcagacaccacagccatgggttattcagtcatcagaaatacacaccgttcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaataaatgatagagtgcgcgccgaaactctctctttcttttttccttggtttgtggagtttagtaata

SEQ ID NO: 355239 - DNA, 1215 bp, Homo sapiens
ctaggccccgccccctgacccgcaccttcccgccgcccctccccggttccatttcattgttggattgtggcgcttcactcctgctggcggccggcagggggcggagttcgagcctggatttttttcctcggggcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcgggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacagtatgtatgctgcaattcgatatgatacagtgctagctttaagtcttctctagttatattgaagcaactcaggttttggcattaaattgttccattttaaaatgcatcattaatacctaaactgtatcatagaatgaaagtatatgttaaaaagtgagatctttgtattgacagctgtcatataattttgaaaagtaaaaattttgactgccgaatatagaagaaaattttggggtaaaaaggagaatttttcctatttacatgtttatattaatctctagtaaaacattgtttttgttgtctttatgatgcatgcgaacataaatgtctgtatttcattcttgttggcttttgttacccacaattacatactattcttactaatctgagagttttctaaagtatgttttcaatgtttcactactctctactctgttaatttgtgctacagtttttcctaaaagagaatggaaaaatgatttaattttttaaactgtagcaattggatagataattttatttgaaattttacacactgaaagctctaaataaacagatacattcacattca

SEQ ID NO: 355240 - DNA, 930 bp, Homo sapiens
agctgggaacattcttagccaccgaagtatgggcaccaaaagcgataaggagcatgtgttccttaataaatgtcacatcagaaaatgactgttccaggacagtaaccacctcccgatggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacagtatgtatgctgcaattcgatatgatacagtgctagctttaagtcttctctagttatattgaagcaactcaggttttggcattaaattgttccattttaaaatgcatcattaatacctaaactgtatcatagaatgaaagtatatgttaaaaagtgagatctttgtattgacagctgtcatataattttgaaaagtaaaaattttgactgccgaatatagaagaaaattttggggtaaaaaggagaatttttcctatttacatgtttatattaatctctagtaaaacattgtttttgttgtctttatgatgcatgcgaacataaatgtctgtatttcattcttgttggcttttgttacccacaattacatactattcttactaatctgagagttttctaaagtatgttttcaatgtttcactactctctactctgttaatttgtgctacagtttttcctaaaagagaatggaaaaatgatttaattttttaaactgtagcaattggatagataattttatttgaaattttacacactgaaagctctaaataaacagatacattcacattca

SEQ ID NO: 355241 - DNA, 966 bp, Homo sapiens
tttgtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtggtaagatcgagcctcctactgaggccgtccctgcatgcgcctggtgagaaatggattatgtattgtataagctggcgggttctttactcttactccatcctcttactccatctataggaacttgcgattcagagctcctctagtgttcagtcagggaagtgcttgtcttttacttgttctcccagcctctggtatttaaatttgtaatcggtaatttttcactaggtttgcttttctcagtaacaaagagtgattttggaagacttagttactaataacctttgtgtgcttgcagtgttgtttattcagtggtcttgtttgtaatacagtactgaatttgcagttgaattaagagttttaaacaacttcactacaatttagctcttcgaagttaatgggtctcagccctctttgtggataggaacattggattgtcttgagtaagtaaaacctgtattacattgtttttaaaactgtcttgaggaactatttttttctcgaagttttgtgaagttctagagatgctatagactgcagaactcaaatgatgaatttattataagacatagatgaacttaaaatcatctcaaacactgcatgtcatatgattcttagaaccagaaggcacttttgtacatatattttctaaaaattattggttaatatctttctttaccaagcctttcattcctattacccctttgacttgtctaagcataagactcataacaaaaaataaataaaatgatgtgaaaacgctgtgta

SEQ ID NO: 355242 - DNA, 843 bp, Homo sapiens
ctaggccccgccccctgacccgcaccttcccgccgcccctccccggttccatttcattgttggattgtggcgcttcactcctgctggcggccggcagggggcggagttcgagcctggatttttttcctcggggcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtcttta

SEQ ID NO: 355243 - DNA, 2862 bp, Homo sapiens
ctggtacggtcggagttatgggatgcggagccgggtgcggtggagcagcagaggcgccccacgcccgcttcgtgcgctcagctgccccgggacccgcctgcctcctcgcgaacttgggacgagttggaaaatcctccctgagagagccgtgcggctcaggggagcggtttaactcggaaaaggaaaaggaatccagaagataaataaagaaaacaggaaaggaggaaagcattgattacaaatgtcttaacaatgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcagtgcagtgagctgagatcaggcaccagaagaggctccccagctgtaactctagtgcagttaccttcgggccaaactatacatgtccagggagtaattcagacaccacagccatgggttattcagtcatcagaaatacacaccgttcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355244 - DNA, 1968 bp, Homo sapiens
acatgcttgctaatttggaacactttatgttgaactgtggtagaggaaacaagacagttctgtctgcagaagcccattatggctgtaactggagatgacacagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355245 - DNA, 2344 bp, Homo sapiens
ctggtacggtcggagttatgggatgcggagccgggtgcggtggagcagcagaggcgccccacgcccgcttcgtgcgctcagctgccccgggacccgcctgcctcctcgcgaacttgggacgagttggaaaatcctccctgagagagccgtgcggctcaggggagcggtttaactcggaaaaggaaaaggaatccagaagataaataaagaaaacaggaaaggaggaaagcattgattacaaatgtcttaacaatgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcagtgcagtgagctgagatcaggcaccagaagaggctccccagctgtaactctagtgcagttaccttcgggccaaactatacatgtccagggagtaattcagacaccacagccatgggttattcagtcatcagaaatacacaccgttcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagttttttaaataagaaaccattgttgtggttggccccttttgttagttgttttgggggcctcatattaaaattttctggaacacatttttc

SEQ ID NO: 355246 - DNA, 2420 bp, Homo sapiens
ctaggccccgccccctgacccgcaccttcccgccgcccctccccggttccatttcattgttggattgtggcgcttcactcctgctggcggccggcagggggcggagttcgagcctggatttttttcctcggggcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcggacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355247 - DNA, 2460 bp, Homo sapiens
ctggtacggtcggagttatgggatgcggagccgggtgcggtggagcagcagaggcgccccacgcccgcttcgtgcgctcagctgccccgggacccgcctgcctcctcgcgaacttgggacgagttggaaaatcctccctgagagagccgtgcggctcaggggagcggtttaactcggaaaaggaaaaggaatccagaagataaataaagaaaacaggaaaggaggaaagcattgattacaaatgtcttaacaatgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcagtgcagtgagctgagatcaggcaccagaagaggctccccagctgtaactctagtgcagttaccttcgggccaaactatacatgtccagggagtaattcagacaccacagccatgggttattcagtcatcagaaatacacaccgttcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355248 - DNA, 2268 bp, Homo sapiens
ctaggccccgccccctgacccgcaccttcccgccgcccctccccggttccatttcattgttggattgtggcgcttcactcctgctggcggccggcagggggcggagttcgagcctggatttttttcctcggggcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcggctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355249 - DNA, 2428 bp, Homo sapiens
ctggtacggtcggagttatgggatgcggagccgggtgcggtggagcagcagaggcgccccacgcccgcttcgtgcgctcagctgccccgggacccgcctgcctcctcgcgaacttgggacgagttggaaaatcctccctgagagagccgtgcggctcaggggagcggtttaactcggaaaaggaaaaggaatccagaaacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacactgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355250 - DNA, 2011 bp, Homo sapiens
agctgggaacattcttagccaccgaagtatgggcaccaaaagcgataaggagcatgtgttccttaataaatgtcacatcagaaaatgactgttccaggacagtaaccacctcccgatggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355251 - DNA, 2145 bp, Homo sapiens
tttgtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtggtaagatcgagcctcctactgaggccgtccctgcatgcgcctgatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355252 - DNA, 1521 bp, Homo sapiens
  misc_feature (3)..(3): n is a, c, g, or t
  misc_feature (10)..(13): n is a, c, g, or t
  misc_feature (16)..(18): n is a, c, g, or t
  misc_feature (21)..(21): n is a, c, g, or t
atnctgtatnnnnatnnnacngatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355253 - DNA, 1866 bp, Homo sapiens
ctaggccccgccccctgacccgcaccttcccgccgcccctccccggttccatttcattgttggattgtggcgcttcactcctgctggcggccggcagggggcggagttcgagcctggatttttttcctcggggcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcggctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacagga

SEQ ID NO: 355254 - DNA, 1134 bp, Homo sapiens
ctggtacggtcggagttatgggatgcggagccgggtgcggtggagcagcagaggcgccccacgcccgcttcgtgcgctcagctgccccgggacccgcctgcctcctcgcgaacttgggacgagttggaaaatcctccctgagagagccgtgcggctcaggggagcggtttaactcggaaaaggaaaaggaatccagaaacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacagtatgtatgctgcaattcgatatgatacagtgctagctttaagtcttctctagttatattgaagcaactcaggttttggcattaaattgttccattttaaaatgcatcattaatacctaaactgtatcatagaatgaaagtatatgttaaaaagtgagatctttgtattgacagctgtcatataattttgaaaagtaaaaattttgactgccgaatatagaagaaaattttggggtaaaaaggagaatttttcctatttacatgtttatattaatctctagtaaaacattgtttttgttgtctttatgatgcatgcgaacataaatgtctgtatttcattcttgttggcttttgttacccacaattacatactattcttactaatctgagagttttctaaagtatgttttcaatgtttcactactctctactctgttaatttgtgctacagtttttcctaaaagagaatggaaaaatgatttaattttttaaactgtagcaattggatagataattttatttgaaattttacacactgaaagctctaaataaacagatacattcacattca

SEQ ID NO: 355255 - DNA, 908 bp, Homo sapiens
ctggtacggtcggagttatgggatgcggagccgggtgcggtggagcagcagaggcgccccacgcccgcttcgtgcgctcagctgccccgggacccgcctgcctcctcgcgaacttgggacgagttggaaaatcctccctgagagagccgtgcggctcaggggagcggtttaactcggaaaaggaaaaggaatccagaagataaataaagaaaacaggaaaggaggaaagcattgattacaaatgtcttaacaatgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcaggggaactgggcaagggcaattttttcaaaaaccaaatttggaacccaaaaaaacacttttttcccaagggggaaggccttcctcgtttcacaaacgcccaaaggtgctgtgcctttttaaacccaaaaattgttgaggttaacccaagggttaacacggcctaggcaaaatctcagaaagattcccga

SEQ ID NO: 355256 - DNA, 1129 bp, Homo sapiens
gcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggcca

SEQ ID NO: 355257 - DNA, 745 bp, Homo sapiens
cggacgcgtgggtcgacccacgcgtcgcgtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggcca

SEQ ID NO: 355258 - DNA, 833 bp, Homo sapiens
  misc_feature (26)..(26): n is a, c, g, or t
ccggccgactctagaggaaacccaantcggcccgggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccaaaaaaataaaaaagagaaccctaaatttgaatataaaaggattattaaaaaaaaaccttgt

SEQ ID NO: 355259 - DNA, 925 bp, Homo sapiens
cggacgcgtgggtcgacccacgcgtcgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggcca

SEQ ID NO: 355260 - DNA, 1270 bp, Homo sapiens
  misc_feature (1135)..(1135): n is a, c, g, or t
gcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccaaaaaanaaaaaagaaactcgggtttggggggaaaaaaaggagggaatgttcgccttgaaggaatggcctaggggttcgaagctttaagagaagaaagaaaaagaaaaagaaaggagacaaataagaaagtaatacataggg

SEQ ID NO: 355261 - DNA, 1246 bp, Homo sapiens
gcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccaaaaaagagagaaggaggagaaagaaaagaaggggggtgcggcgaagagggaccaaatttgggaggactcccgccggaatagggaaagggggagaaagggccccaaaaggggagagga

SEQ ID NO: 355262 - DNA, 1473 bp, Homo sapiens
gcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccatcaaaaaaaaaaaaaaaaaaaaaaaaaaaatttggggggggccggggcctggaaaaggttttcaagcacattcgcggtgggcgccggcgggcgcacccaaggtaggtctatgtggacacttggcccataaacgctggtccccaaaaggggaaaaccccgggtcgaaggattaaagcggctgggtttctccccaccaatttaaaaaaaacgcgccgcggggggaaacaccagcggctgtttctggaaccaatcccgagaaggaggtccgagacggccgtaacgggattcctaccaacaagggtgccaagggggagacgaaaaaaatacgcgggcgggggggggag

SEQ ID NO: 355263 - DNA, 908 bp, Homo sapiens
gggggaggaagcgaccaggtccggcacgaaggagggagaggtggcctgaggagcggaggggggatgtgtggattccggtgaaagggacctgacaatcgcccccaacccctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggcca

SEQ ID NO: 355264 - DNA, 1156 bp, Homo sapiens
  misc_feature (1088)..(1088): n is a, c, g, or t
  misc_feature (1096)..(1096): n is a, c, g, or t
  misc_feature (1105)..(1105): n is a, c, g, or t
  misc_feature (1111)..(1111): n is a, c, g, or t
gcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaagggcgtcnggggggantgaaagganaagggnaaaaaacgcaaacagaacaacaaacaaaacggtttgggaacaacg

SEQ ID NO: 355265 - DNA, 1226 bp, Homo sapiens
  misc_feature (1226)..(1226): n is a, c, g, or t
gcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccgtatgtttagttacataaggagccgtatcgggggaacttaattgttcagaagggacaccaacaaaaaaaaaagggggctaaactcagggcaaagcccttgtaagcaaaagataaaaggggggaatgggaagggttgaacctggtggcccacggaaatgtttggtatcaaacn

SEQ ID NO: 355266 - DNA, 1176 bp, Homo sapiens
gcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtctgagctgattttcttcttttgcaccttcggactgttgtttagtactaagggccgccggggacagaaccgtgaaaaggccaaacaaacaaaaggggggaacctcgggcccccatttaggccaggttaacgcggcacgggggggggtcgggccaccaatattgtgttaaacg

SEQ ID NO: 355267 - DNA, 1717 bp, Homo sapiens
gcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatggtgaggcctctctgctcctacctgcctccttctgagcagtaagagacacaggttcctgcagcaagaagtcatgtttaagccctgtttaaggaagctagctgagaagaggggaagaaccccagaacttgggcctgggaattgaattctgattgggggtcatcctgaagggattgttttcagggagggagacagaccttgaatcagagagttgtgatagactgcctcttcctcaaggaacaaacaacaaatggctctgatggtttgtagcctgcctaattggaagaaaggcaacacagaagtttgagagcccatctagtccagagaaggggcctctggacagaggtgggaggagtgggggacagagtggtatgggttgggctgcgaagggagttgcctcttctttacatctacctgccaaccccttccattgtattcacctcagttggaaaagtaccagcaaggagactttggttactgtcctcgtgtgtactgtgagaaccagccaatgcttcccattggtgagtgttgaagaagggaaaggaaagcaccgtgtggcagtcttatgggaaggagttggggctcaacacattggagcctgagtcctgaggggaggttaggtaggaatagggggatacctggcctgctgagtctggctgtctcccaggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggcca

SEQ ID NO: 355268 - DNA, 772 bp, Homo sapiens
  misc_feature (26)..(26): n is a, c, g, or t
ccggccgactctagaggaaacccaantcggcccgggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggcca

SEQ ID NO: 355269 - DNA, 934 bp, Homo sapiens
  misc_feature (18)..(19): n is a, c, g, or t
  misc_feature (22)..(22): n is a, c, g, or t
  misc_feature (25)..(25): n is a, c, g, or t
accttaggcagtagaggnnggngtnaatcggccgaggcgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggcca

SEQ ID NO: 355270 - DNA, 560 bp, Homo sapiens
acaatgcccttcgccttcctcaacgtggcccccgctccaagcccattttctggagccaggaatccactctgtgggttaggaaaggccctcaggaggcggagggaaacctgtggaatgccgagaagccgtgtaatgaaataacgtcacgcctgcccctcaccattactctgaccagggttcgaaggtcacacttagagcctaaggggaaatggagaagtgcaaagggacgagcagaatggctggcaccacctcaggttagcgcactgggacgttccagttctcacaccgcccaccccaccccacccaagtccctacgcacggagccaagccgcacctctcccctcatgaggcaggagcccggaggaaacagtatgcccgtcaagggtctctggcgggactgattcgcactaggggcccaacaggcaataaggacccagcggattggccgaggataggccagtcccctgggcagcagcgccgcgccgggactagaggggaacgtgaggagagctgcggaaagagatccagcctggcttcctcctttccccgccctaagtcag

SEQ ID NO: 355271 - DNA, 1460 bp, Homo sapiens
gcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccaaaaaaaaaagcagtatccgccgcatcctcttccgtgaggcgcgctgagacccggaccggccctcctgagaggatgccggtgcgggcgcccgcggagagggacccgtcgccatgggccgtgtgatccgtggcacagaggaagggcgccgggtctgtgtcccgcgcgcacgttgaagcaccgtaaaggcggctgcgcgctgcgcgcggtggatttcgctgagcggacggttaatcagggctcggtcaggacctctccacgaccgggcggggcgcccttgcagggggtctccggatccgattggttaaaagggacggactgtcatgcgccgagg

SEQ ID NO: 355272 - DNA, 1190 bp, Homo sapiens
gcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccaaaaaaataaaaaagagaaccctaaatttgaatataaaaggattattaaaaaaaaaccttgt

SEQ ID NO: 355273 - DNA, 1054 bp, Homo sapiens
acaatgcccttcgccttcctcaacgtggcccccgctccaagcccattttctggagccaggaatccactctgtgggttaggaaaggccctcaggaggcggagggaaacctgtggaatgccgagaagccgtgtaatgaaataacgtcacgcctgcccctcaccattactctgaccagggttcgaaggtcacacttagagcctaaggggaaatggagaagtgcaaagggacgagcagaatggctggcaccacctcagctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggcca

SEQ ID NO: 355274 - DNA, 999 bp, Homo sapiens
gggggaggaagcgaccaggtccggcacgaaggagggagaggtggcctgaggagcggaggggggatgtgtggattccggtgaaagggacctgacaatcgcccccaacccgtgagaaaaggaggagcccggttcttgcttgagaatgataaacttggaaacccttgggaaaggcgtgggggtcatgcagagacttgtattgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggcca

SEQ ID NO: 355275 - DNA, 943 bp, Homo sapiens
cggacgcgtgggtcgacccacgcgtcgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagcttccatgtcctgacaggtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggcca

SEQ ID NO: 355276 - DNA, 1571 bp, Homo sapiens
gcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatggtgaggcctctctgctcctacctgcctccttctgagcagtaagagacacaggttcctgcagcaagaagtcatgtttaagccctgtttaaggaagctagctgagaagaggggaagaaccccagaacttgggcctgggaattgaattctgattgggggtcatcctgaagggattgttttcagggagggagacagaccttgaatcagagagttgtgatagactgcctcttcctcaaggaacaaacaacaaatggctctgatggtttgtagcctgcctaattggaagaaaggcaacacagaagtttgagagcccatctagtccagagaaggggcctctggacagaggtgggaggagtgggggacagagtggtatgggttgggctgcgaagggagttgcctcttctttacatctacctgccaaccccttccattgtattcacctcagttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggcca

SEQ ID NO: 355277 - DNA, 1275 bp, Homo sapiens
gcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggtgagtgttgaagaagggaaaggaaagcaccgtgtggcagtcttatgggaaggagttggggctcaacacattggagcctgagtcctgaggggaggttaggtaggaatagggggatacctggcctgctgagtctggctgtctcccaggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggcca

SEQ ID NO: 355278 - DNA, 6061 bp, Homo sapiens
gctgagatttagccgtgcgatgcccgcgcaggggcgggggccgcgggccaggggaggcgctcagagtccggagccgccgagcgagataaccagcccgagtcatgcagtcttttcgagaaaggtgtggtttccatggcaaacaacagaactaccagcagacctcgcaggaaacatcacgcctagagaattacaggcagccgagtcaggccgggctaagctgcgaccggcagcggctgctcgccaaggactattataacccgcagccttacccgagctatgagggtggcgctggcacgccctctggcactgcagccgcggtggccgccgacaagtaccaccgaggcagcaaggccctgcccacacagcaaggcctgcaggggaggccggctttccctggctacggcgtccaggacagcagcccctacccaggccgctatgctggtgaggagagccttcaggcttggggggccccacagccaccacccccacagccgcagccactacctgcaggggtggccaagtatgatgagaacttgatgaaaaagacagcagtgccccccagcaggcagtatgcagagcagggcgcccaggtgccctttcggactcactccctgcacgtccagcagccaccgccgccccagcagcccctggcataccccaagctccaaaggcagaagctgcagaacgacattgcctcccctctgcccttcccccaggggtggtgggcagggggcccactcctataagagttgcacagcaccgactgcccagccccatgacaggccgctgactgccagctccagcctggccccggggcagcgggtccagaatcttcatgcctaccagtcgggccgcctcagctatgaccagcagcagcagcagcagcagcagcagcagcagcagcagcaagcccttcagagccggcaccatgcccaggaaaccctccattaccaaaacctcgccaagtatcagcactacgggcagcaaggccagggctactgccagccggacgcagccgtccggaccccagagcagtactaccagaccttcagccccagctccagccactcacccgcccgctccgtgggccgctcaccttcctacagttccacaccgtcgccgctgatgccaaacctggagaactttccctacagccagcagccgctcagcaccggggccttccccgcagggatcactgaccacagccacttcatgcccctgctcaatccctccccaacggatgccaccagctctcctgcagagcctcacggcgctgacctcacaggtggagaacatctccaacaccgtccagcagctgctgctctccaaggctgctgtgccgcagaagaaaggtgtcaagaacctcgtgtccaggaccccagagcagcataaaagccagcactgcagccccgaagggagcggctactcagccgagcccgcaggcacaccgctgtcagagccgccgagcagcacgccacagtccacgcatgcggagccgcaggaggccgactacctgagcggctccgaggacccactggagcgcagcttcctctactgcaaccaggcccgtggcagccctgccagggtcaacagcaactcgaaggccaagcccgagtccgtgtccacctgttctgtgacctctcctgacgacatgtccaccaaatctgacgactccttccagagcctacacggcagtctgccgctcgacagcttctccaagttcgtggcgggtgagcgggactgtccgcggctgctgctcagcgccctggcacaggaggacctggcctccgagatcctggggctgcaggaagccatcggtgagaaggccgacaaagcttgggctgaagcacccagcctggtcaaggacagcagcaagccacccttctcgctggagaaccacagcgcctgcctggactctgtggccaagagtgcgtggccccggcctggggagccggaggccctgcccgactccttgcagctggacaagggcggcaatgccaaggacttcagcccagggctgtttgaagacccttccgtggccttcgctacgcctgaccccaaaaagacaactggtcctctctcctttggtaccaagcccacccttggggttcctgctccagaccccactacagcagcttttgactgtttcccggacacaaccgctgccagctcagcggacagcgccaacccctttgcctggccagaggaaaacctgggggatgcttgtcccaggtggggattgcaccctggcgagcttaccaagggcctggagcagggtgggaaggcctcagatggcatcagcaaaggggacacccatgaggcttcggcctgcctgggcttccaggaggaggacccccctggggagaaggtggcctcgttgcccggggacttcaagcaggaggaggtgggtggggtgaaggaggaggcaggtgggctgctgcagtgccccgaggtggccaaggctgaccggtggctggaggacagccggcactgctgttccaccgccgacttcggggacctcccactgctgccacccaccagcaggaaggaggacctggaagctgaggaggagtactcctccctatgtgagctcctgggcagccccgagcagaggcctggcatgcaggacccgctgtcacccaaggccccactcatctgcaccaaggaggaggtggaggaggtgctggactccaaggccggctggggctctccgtgccacctctcaggggagtccgtcatcctgctgggccctacagtgggcaccgagtcaaaggtccagagctggtttgagtcctctctgtcacacatgaagccaggtgaagaggggcctgatggggagcgagctccaggggattccaccacctcggacgcctctctggcccagaagcccaacaagcctgctgtgcccgaggcgcccatcgcaaagaaagagcctgtgccacggggcaaaagcttacggagccgtcgggtgcaccgggggctgcccgaggccgaggactccccatgcagggcaccagtgctgcccaaagacctcttgctccctgaatcctgcacagggcccccccagggacagatggaaggggctggagccccaggccggggggcctcggaagggctccccaggatgtgtactcgttctctcacggccctgagtgagccccgcacgcccggacccccaggcctgaccaccacccctgcacccccagacaaactggggggcaagcagcgagccgccttcaagtcgggcaagcgggtggggaagccctcacccaaggctgcctccagccccagcaacccggccgccctgcctgtggcctccgacagcagcccgatgggctccaagaccaaggagacagactcacccagcacgcctggcaaggaccagcgctccatgatccttcggtcacgcaccaaaacccaggagatcttccactccaagcggcggaggccctctgagggccggctccccaactgccgtgccaccaagaagctcctcgacaacagccacttgcccgccacattcaaggtctccagcagcccccagaaggagggcagggtgagccagcgggcaagggtccccaaacctggtgcaggcagcaagctctctgaccggcccctccatgcgctcaaaaggaagtcggccttcatggcgccggtccccaccaagaagcggaacctggtcttgcggagccgcagcagcagcagcagcaacgccagtggcaatgggggagatgggaaggaggagaggcctgagggttcccccaccctcttcaagaggatgtcttctcccaagaaagccaagcccaccaagggcaatggcgagcctgccacaaagctcccacccccggagacccccgatgcctgcctcaagctcgcctctcgggcagccttccagggggccatgaagaccaaggtgctgccaccccggaagggccggggcctgaagctggaagccatcgtgcagaagatcacctcgcccagcctcaagaagttcgcatgtaaagcgccaggggcctctcctggtaatcctctgagcccatccctttccgacaaagaccgtgggctcaagggtgctgggggcagcccagtgggggtggaagaaggcctggtaaatgtgggcaccgggcagaagctcccaacttctggggctgatccgttatgcagaaatccaaccaacagatccttaaaaggcaaactcatgaacaagggccagtggcacacaaggggccagtgaggacaactctggtggaggaggcaagaagccaaagatggaggagctgggcctggcctcccagcccccggagggcaggccctgccagccccagacaagggcacagaaacagccaggccacaccaactacagcagctattccaagcggaagcgcctcactcggggccgggccaagaacaccacctcttcaccctgtaaggggcgtgccaagcgacgacgacagcagcaggtgctgcccctggatcccgcagagcctgaaatccgcctcaagtacatttcctcttgcaagcggctgaggtcagacagccggacccccgccttctcacccttcgtgcgggtggagaagcgagacgcgttcaccaccatatgcactgttgtcaactcccctggagatgcgcccaagccccacaggaagccttcctcctctgcctcctcttcctcatcctcgtcctcgttctccttggatgcagccggggcctccctggccacactccctggaggctccatcctgcagccgcggccctccttgcccctctcctccacgatgcacttggggcctgtggtttccaaggccctgagtacctcttgccttgtttgctgcctctgccaaaacccggccaacttcaaggaccttggggacctctgtgggccctactaccctgaacactgcctccccaaaaagaagccaaaactcaaggagaaggtgcggccagaaggcacctgtgaggaggcctcgctgccgcttgagagaacactcaaaggtcccgagtgtgcagctgccgccactgccgggaagccccccaggcctgacggcccagctgacccggccaagcagggcccactgcgcaccagtgcccggggcctgtcccggaggctgcagagctgctactgctgtgatggccgggaggatgggggcgaggaggcagccccagccgacaagggagcactgggtgcatgaggcctgtgccgtgtggaccggcggcgtctacctggtggccgggaagctctttgggctgcaggaggccatgaaggtggccgtggacatgcacggtggcactgtggctctggcgcctggtgacttctccctccccggcctcaggtttgcttcactcttccaagggccttcttggtgtgactgtcctgtcctggccacgtccactccaagcagctggtccagatgtgttccagctgccaagaagccggggccaccattgggtgctgccacaaaggatgcctccacacctaccactacccgtgtgccagcgatgcaggtacgagcccgcccaggaacaggagggcattggagcccatccaagcagtccagggggaccctccctgggcacagctccccaaacccaggccccatctcactcttcagtttccctcctctcttgccccagcaattcttttatccttctgtctgcctagacctctgctgggcaatgccagggacatggaaatgaggcattccccaggcacctgcttgaggagtgcccagagcagtgagggaagatagaagcataaattacaatgtggaatgctgtctgcggagccatcattgccaaggggcagggaggatctcaggcctcagagagaaaggggtattggaggttgggcctttgaaggataaataggagttcactcagcagagacaaggggaaaggcactactacaacagcaaaaaccaactgagttgggggtgatgaggttcaaaacagactgagacccatggagcaattgtggaagttttgaagcagggtaatggggtatggaggtaggcccaggctccccgcatcctctccccggtccttcctctcactcatgtattca

SEQ ID NO: 355279 - DNA, 6519 bp, Homo sapiens
tcttgctctccttctccccccgcgcgtcgcccgcccgcccgtccgctcgtccgctcttcctgtgcggaggggatcgcattcctcgcggcacccgcggacaccaggcaggcccggccgggtgcgcggccaaggcccgctccccgcgtccccgggcgccgcccccgcccgcggctgggctccgagagacgagtgggagagcgagtgcagcgagggcgagaggcgagccgagcaggccgccctgcccgcggccctagcgccggcgcgaggagggggcgccgcggcccaccctccttcctgcctggccgcgggccggccgggccgccgcgccccgacccccatggccacccaggcctccgggccgcgaagtcgcagcgccagacccaaggcccccgagtgagcgcgggcgccgaggatctcatctggccaccgcgttctggaagaggcgagagggagagcgtgcgcgagaggagagagacggcgggggaaagggagacggcgagacgcgcagcgccggcgcccgggagacccaggaggagcccgcagataaccagcccgagtcatgcagtcttttcgagaaaggtgtggtttccatggcaaacaacagaactaccagcagacctcgcaggaaacatcacgcctagagaattacaggcagccgagtcaggccgggctaagctgcgaccggcagcggctgctcgccaaggactattataacccgcagccttacccgagctatgagggtggcgctggcacgccctctggcactgcagccgcggtggccgccgacaagtaccaccgaggcagcaaggccctgcccacacagcaaggcctgcaggggaggccggctttccctggctacggcgtccaggacagcagcccctacccaggccgctatgctggtgaggagagccttcaggcttggggggccccacagccaccacccccacagccgcagccactacctgcaggggtggccaagtatgatgagaacttgatgaaaaagacagcagtgccccccagcaggcagtatgcagagcagggcgcccaggtgccctttcggactcactccctgcacgtccagcagccaccgccgccccagcagcccctggcataccccaagctccaaaggcagaagctgcagaacgacattgcctcccctctgcccttcccccaggggtggtgggcagggggcccactcctataagagttgcacagcaccgactgcccagccccatgacaggccgctgactgccagctccagcctggccccggggcagcgggtccagaatcttcatgcctaccagtcgggccgcctcagctatgaccagcagcagcagcagcagcagcagcagcagcagcagcagcaagcccttcagagccggcaccatgcccaggaaaccctccattaccaaaacctcgccaagtatcagcactacgggcagcaaggccagggctactgccagccggacgcagccgtccggaccccagagcagtactaccagaccttcagccccagctccagccactcacccgcccgctccgtgggccgctcaccttcctacagttccacaccgtcgccgctgatgccaaacctggagaactttccctacagccagcagccgctcagcaccggggccttccccgcagggatcactgaccacagccacttcatgcccctgctcaatccctccccaacggatgccaccagctctcctgcagagcctcacggcgctgacctcacaggtggagaacatctccaacaccgtccagcagctgctgctctccaaggctgctgtgccgcagaagaaaggtgtcaagaacctcgtgtccaggaccccagagcagcataaaagccagcactgcagccccgaagggagcggctactcagccgagcccgcaggcacaccgctgtcagagccgccgagcagcacgccacagtccacgcatgcggagccgcaggaggccgactacctgagcggctccgaggacccactggagcgcagcttcctctactgcaaccaggcccgtggcagccctgccagggtcaacagcaactcgaaggccaagcccgagtccgtgtccacctgttctgtgacctctcctgacgacatgtccaccaaatctgacgactccttccagagcctacacggcagtctgccgctcgacagcttctccaagttcgtggcgggtgagcgggactgtccgcggctgctgctcagcgccctggcacaggaggacctggcctccgagatcctggggctgcaggaagccatcggtgagaaggccgacaaagcttgggctgaagcacccagcctggtcaaggacagcagcaagccacccttctcgctggagaaccacagcgcctgcctggactctgtggccaagagtgcgtggccccggcctggggagccggaggccctgcccgactccttgcagctggacaagggcggcaatgccaaggacttcagcccagggctgtttgaagacccttccgtggccttcgctacgcctgaccccaaaaagacaactggtcctctctcctttggtaccaagcccacccttggggttcctgctccagaccccactacagcagcttttgactgtttcccggacacaaccgctgccagctcagcggacagcgccaacccctttgcctggccagaggaaaacctgggggatgcttgtcccaggtggggattgcaccctggcgagcttaccaagggcctggagcagggtgggaaggcctcagatggcatcagcaaaggggacacccatgaggcttcggcctgcctgggcttccaggaggaggacccccctggggagaaggtggcctcgttgcccggggacttcaagcaggaggaggtgggtggggtgaaggaggaggcaggtgggctgctgcagtgccccgaggtggccaaggctgaccggtggctggaggacagccggcactgctgttccaccgccgacttcggggacctcccactgctgccacccaccagcaggaaggaggacctggaagctgaggaggagtactcctccctatgtgagctcctgggcagccccgagcagaggcctggcatgcaggacccgctgtcacccaaggccccactcatctgcaccaaggaggaggtggaggaggtgctggactccaaggccggctggggctctccgtgccacctctcaggggagtccgtcatcctgctgggccctacagtgggcaccgagtcaaaggtccagagctggtttgagtcctctctgtcacacatgaagccaggtgaagaggggcctgatggggagcgagctccaggggattccaccacctcggacgcctctctggcccagaagcccaacaagcctgctgtgcccgaggcgcccatcgcaaagaaagagcctgtgccacggggcaaaagcttacggagccgtcgggtgcaccgggggctgcccgaggccgaggactccccatgcagggcaccagtgctgcccaaagacctcttgctccctgaatcctgcacagggcccccccagggacagatggaaggggctggagccccaggccggggggcctcggaagggctccccaggatgtgtactcgttctctcacggccctgagtgagccccgcacgcccggacccccaggcctgaccaccacccctgcacccccagacaaactggggggcaagcagcgagccgccttcaagtcgggcaagcgggtggggaagccctcacccaaggctgcctccagccccagcaacccggccgccctgcctgtggcctccgacagcagcccgatgggctccaagaccaaggagacagactcacccagcacgcctggcaaggaccagcgctccatgatccttcggtcacgcaccaaaacccaggagatcttccactccaagcggcggaggccctctgagggccggctccccaactgccgtgccaccaagaagctcctcgacaacagccacttgcccgccacattcaaggtctccagcagcccccagaaggagggcagggtgagccagcgggcaagggtccccaaacctggtgcaggcagcaagctctctgaccggcccctccatgcgctcaaaaggaagtcggccttcatggcgccggtccccaccaagaagcggaacctggtcttgcggagccgcagcagcagcagcagcaacgccagtggcaatgggggagatgggaaggaggagaggcctgagggttcccccaccctcttcaagaggatgtcttctcccaagaaagccaagcccaccaagggcaatggcgagcctgccacaaagctcccacccccggagacccccgatgcctgcctcaagctcgcctctcgggcagccttccagggggccatgaagaccaaggtgctgccaccccggaagggccggggcctgaagctggaagccatcgtgcagaagatcacctcgcccagcctcaagaagttcgcatgtaaagcgccaggggcctctcctggtaatcctctgagcccatccctttccgacaaagaccgtgggctcaagggtgctgggggcagcccagtgggggtggaagaaggcctggtaaatgtgggcaccgggcagaagctcccaacttctggggctgatccgttatgcagaaatccaaccaacagatccttaaaaggcaaactcatgaacaagggccagtggcacacaaggggccagtgaggacaactctggtggaggaggcaagaagccaaagatggaggagctgggcctggcctcccagcccccggagggcaggccctgccagccccagacaagggcacagaaacagccaggccacaccaactacagcagctattccaagcggaagcgcctcactcggggccgggccaagaacaccacctcttcaccctgtaaggggcgtgccaagcgacgacgacagcagcaggtgctgcccctggatcccgcagagcctgaaatccgcctcaagtacatttcctcttgcaagcggctgaggtcagacagccggacccccgccttctcacccttcgtgcgggtggagaagcgagacgcgttcaccaccatatgcactgttgtcaactcccctggagatgcgcccaagccccacaggaagccttcctcctctgcctcctcttcctcatcctcgtcctcgttctccttggatgcagccggggcctccctggccacactccctggaggctccatcctgcagccgcggccctccttgcccctctcctccacgatgcacttggggcctgtggtttccaaggccctgagtacctcttgccttgtttgctgcctctgccaaaacccggccaacttcaaggaccttggggacctctgtgggccctactaccctgaacactgcctccccaaaaagaagccaaaactcaaggagaaggtgcggccagaaggcacctgtgaggaggcctcgctgccgcttgagagaacactcaaaggtcccgagtgtgcagctgccgccactgccgggaagccccccaggcctgacggcccagctgacccggccaagcagggcccactgcgcaccagtgcccggggcctgtcccggaggctgcagagctgctactgctgtgatggccgggaggatgggggcgaggaggcagccccagccgacaagggagcactgggtgcatgaggcctgtgccgtgtggaccggcggcgtctacctggtggccgggaagctctttgggctgcaggaggccatgaaggtggccgtggacatgcacggtggcactgtggctctggcgcctggtgacttctccctccccggcctcaggtttgcttcactcttccaagggccttcttggtgtgactgtcctgtcctggccacgtccactccaagcagctggtccagatgtgttccagctgccaagaagccggggccaccattgggtgctgccacaaaggatgcctccacacctaccactacccgtgtgccagcgatgcaggtacgagcccgcccaggaacaggagggcattggagcccatccaagcagtccagggggaccctccctgggcacagctccccaaacccaggccccatctcactcttcagtttccctcctctcttgccccagcaattcttttatccttctgtctgcctagacctctgctgggcaatgccagggacatggaaatgaggcattccccaggcacctgcttgaggagtgcccagagcagtgagggaagatagaagcataaattacaatgtggaatgctgtctgcggagccatcattgccaaggggcagggaggatctcaggcctcagagagaaaggggtattggaggttgggcctttgaaggataaataggagttcactcagcagagacaaggggaaaggcactactacaacagcaaaaaccaactgagttgggggtgatgaggttcaaaacagactgagacccatggagcaattgtggaagttttgaagcagggtaatggggtatggaggtaggcccaggctccccgcatcctctccccggtccttcctctcactcatgtattca

SEQ ID NO: 355280 - DNA, 7248 bp, Homo sapiens
gctgagatttagccgtgcgatgcccgcgcaggggcgggggccgcgggccaggggaggcgctcagagtccggagccgccgagcgagataaccagcccgagtcatgcagtcttttcgagaaaggtgtggtttccatggcaaacaacagaactaccagcagacctcgcaggaaacatcacgcctagagaattacaggcagccgagtcaggccgggctaagctgcgaccggcagcggctgctcgccaaggactattataacccgcagccttacccgagctatgagggtggcgctggcacgccctctggcactgcagccgcggtggccgccgacaagtaccaccgaggcagcaaggccctgcccacacagcaaggcctgcaggggaggccggctttccctggctacggcgtccaggacagcagcccctacccaggccgctatgctggtgaggagagccttcaggcttggggggccccacagccaccacccccacagccgcagccactacctgcaggggtggccaagtatgatgagaacttgatgaaaaagacagcagtgccccccagcaggcagtatgcagagcagggcgcccaggtgccctttcggactcactccctgcacgtccagcagccaccgccgccccagcagcccctggcataccccaagctccaaaggcagaagctgcagaacgacattgcctcccctctgcccttcccccagggtacccactttcctcagcattcccagtccttccccacctcctccacctactcctcctctgtccagggtggtgggcagggggcccactcctataagagttgcacagcaccgactgcccagccccatgacaggccgctgactgccagctccagcctggccccggggcagcgggtccagaatcttcatgcctaccagtcgggccgcctcagctatgaccagcagcagcagcagcagcagcagcagcagcagcagcagcaagcccttcagagccggcaccatgcccaggaaaccctccattaccaaaacctcgccaagtatcagcactacgggcagcaaggccagggctactgccagccggacgcagccgtccggaccccagagcagtactaccagaccttcagccccagctccagccactcacccgcccgctccgtgggccgctcaccttcctacagttccacaccgtcgccgctgatgccaaacctggagaactttccctacagccagcagccgctcagcaccggggccttccccgcagggatcactgaccacagccacttcatgcccctgctcaatccctccccaacggatgccaccagctctgtggacacccaggctggcaactgcaagccccttcagaaggacaagctccctgagaacctgctgtcggatctcagcctgcagagcctcacggcgctgacctcacaggtggagaacatctccaacaccgtccagcagctgctgctctccaaggctgctgtgccgcagaagaaaggtgtcaagaacctcgtgtccaggaccccagagcagcataaaagccagcactgcagccccgaagggagcggctactcagccgagcccgcaggcacaccgctgtcagagccgccgagcagcacgccacagtccacgcatgcggagccgcaggaggccgactacctgagcggctccgaggacccactggagcgcagcttcctctactgcaaccaggcccgtggcagccctgccagggtcaacagcaactcgaaggccaagcccgagtccgtgtccacctgttctgtgacctctcctgacgacatgtccaccaaatctgacgactccttccagagcctacacggcagtctgccgctcgacagcttctccaagttcgtggcgggtgagcgggactgtccgcggctgctgctcagcgccctggcacaggaggacctggcctccgagatcctggggctgcaggaagccatcggtgagaaggccgacaaagcttgggctgaagcacccagcctggtcaaggacagcagcaagccacccttctcgctggagaaccacagcgcctgcctggactctgtggccaagagtgcgtggccccggcctggggagccggaggccctgcccgactccttgcagctggacaagggcggcaatgccaaggacttcagcccagggctgtttgaagacccttccgtggccttcgctacgcctgaccccaaaaagacaactggtcctctctcctttggtaccaagcccacccttggggttcctgctccagaccccactacagcagcttttgactgtttcccggacacaaccgctgccagctcagcggacagcgccaacccctttgcctggccagaggaaaacctgggggatgcttgtcccaggtggggattgcaccctggcgagcttaccaagggcctggagcagggtgggaaggcctcagatggcatcagcaaaggggacacccatgaggcttcggcctgcctgggcttccaggaggaggacccccctggggagaaggtggcctcgttgcccggggacttcaagcaggaggaggtgggtggggtgaaggaggaggcaggtgggctgctgcagtgccccgaggtggccaaggctgaccggtggctggaggacagccggcactgctgttccaccgccgacttcggggacctcccactgctgccacccaccagcaggaaggaggacctggaagctgaggaggagtactcctccctatgtgagctcctgggcagccccgagcagaggcctggcatgcaggacccgctgtcacccaaggccccactcatctgcaccaaggaggaggtggaggaggtgctggactccaaggccggctggggctctccgtgccacctctcaggggagtccgtcatcctgctgggccctacagtgggcaccgagtcaaaggtccagagctggtttgagtcctctctgtcacacatgaagccaggtgaagaggggcctgatggggagcgagctccaggggattccaccacctcggacgcctctctggcccagaagcccaacaagcctgctgtgcccgaggcgcccatcgcaaagaaagagcctgtgccacggggcaaaagcttacggagccgtcgggtgcaccgggggctgcccgaggccgaggactccccatgcagggcaccagtgctgcccaaagacctcttgctccctgaatcctgcacagggcccccccagggacagatggaaggggctggagccccaggccggggggcctcggaagggctccccaggatgtgtactcgttctctcacggccctgagtgagccccgcacgcccggacccccaggcctgaccaccacccctgcacccccagacaaactggggggcaagcagcgagccgccttcaagtcgggcaagcgggtggggaagccctcacccaaggctgcctccagccccagcaacccggccgccctgcctgtggcctccgacagcagcccgatgggctccaagaccaaggagacagactcacccagcacgcctggcaaggaccagcgctccatgatccttcggtcacgcaccaaaacccaggagatcttccactccaagcggcggaggccctctgagggccggctccccaactgccgtgccaccaagaagctcctcgacaacagccacttgcccgccacattcaaggtctccagcagcccccagaaggagggcagggtgagccagcgggcaagggtccccaaacctggtgcaggcagcaagctctctgaccggcccctccatgcgctcaaaaggaagtcggccttcatggcgccggtccccaccaagaagcggaacctggtcttgcggagccgcagcagcagcagcagcaacgccagtggcaatgggggagatgggaaggaggagaggcctgagggttcccccaccctcttcaagaggatgtcttctcccaagaaagccaagcccaccaagggcaatggcgagcctgccacaaagctcccacccccggagacccccgatgcctgcctcaagctcgcctctcgggcagccttccagggggccatgaagaccaaggtgctgccaccccggaagggccggggcctgaagctggaagccatcgtgcagaagatcacctcgcccagcctcaagaagttcgcatgtaaagcgccaggggcctctcctggtaatcctctgagcccatccctttccgacaaagaccgtgggctcaagggtgctgggggcagcccagtgggggtggaagaaggcctggtaaatgtgggcaccgggcagaagctcccaacttctggggctgatccgttatgcagaaatccaaccaacagatccttaaaaggcaaactcatgaacagtaagaaactgtcttctactgactgtttcaaaaccgaggccttcacatccccggaggccctgcagcctggggggactgccctggcgcctaagaagaggagccggaaaggccgggcaggggcccatggactctccaaaggcccgctggagaagcggccctatcttggcccggctctgctcctgactccccgagacagggccagtggcacacaaggggccagtgaggacaactctggtggaggaggcaagaagccaaagatggaggagctgggcctggcctcccagcccccggagggcaggccctgccagccccagacaagggcacagaaacagccaggccacaccaactacagcagctattccaagcggaagcgcctcactcggggccgggccaagaacaccacctcttcaccctgtaaggggcgtgccaagcgacgacgacagcagcaggtgctgcccctggatcccgcagagcctgaaatccgcctcaagtacatttcctcttgcaagcggctgaggtcagacagccggacccccgccttctcacccttcgtgcgggtggagaagcgagacgcgttcaccaccatatgcactgttgtcaactcccctggagatgcgcccaagccccacaggaagccttcctcctctgcctcctcttcctcatcctcgtcctcgttctccttggatgcagccggggcctccctggccacactccctggaggctccatcctgcagccgcggccctccttgcccctctcctccacgatgcacttggggcctgtggtttccaaggccctgagtacctcttgccttgtttgctgcctctgccaaaacccggccaacttcaaggaccttggggacctctgtgggccctactaccctgaacactgcctccccaaaaagaagccaaaactcaaggagaaggtgcggccagaaggcacctgtgaggaggcctcgctgccgcttgagagaacactcaaaggtcccgagtgtgcagctgccgccactgccgggaagccccccaggcctgacggcccagctgacccggccaagcagggcccactgcgcaccagtgcccggggcctgtcccggaggctgcagagctgctactgctgtgatggccgggaggatgggggcgaggaggcagccccagccgacaagggtcgcaaacatgagtgcagcaaggaggctccggcagagcccggcggggaggcccaggagcactgggtgcatgaggcctgtgccgtgtggaccggcggcgtctacctggtggccgggaagctctttgggctgcaggaggccatgaaggtggccgtggacatgatgtgttccagctgccaagaagccggggccaccattgggtgctgccacaaaggatgcctccacacctaccactacccgtgtgccagcgatgcaggttgcatattcatcgaagagaacttttctttgaaatgtcccaaacataagaggctgccgtagtaatccaccccaacggccggaggagccgccggagcccgcctgcccgcccgccgccgaaggagaggagccgcctgcgcagcccccgggcctttgagctgctcccagcgctggtccagagccgatccttgatccgggtcccggatcgtggatccggccgcctagggctcagacttgcggccccgggttgggaggaaaacccgttccggagccgcctgctcccggaaccggacggcacagggcgttcttgcccaccccaggggccaggcttgcggagggggagcccgcggagcggccagactccccggggcgctcagcctccggcgagggtgggagacggctttgtcctggggacactttccctctggaatctcaagacgacgtggcacacattccacgtgggtgctgccgccaccccagtcggtcgtggcgtgcagctgggagccctgggcttgggggtgggggtcgaaacagtactggaagaggcggagggcggctcctagctccgtggactaggcgggggagaaaggaagcctttctgagagcgggctaggccggcactggagaggccggagcctttggaacaaaccgtgcggaacgcgtccaggggccttcccgcccagcctttgccagatctctcgtgcggttcgggcaaagccggggtagacctgggctatgctcagttaggggttgcgggatccccgagtgtgggcgggactgggacaccctttggcctctgtttgtcccctttccagtcctccaccccacccctggagcccagcctgggagcgcaaaacccaagaagcggccagaacgcacctccggctccggcggacgcgcgaccgttgtgcaccaccagggaccgccgcgcctactctgcacgggagcagggacagcgctagatttcgtgtacaaaacctgtgtacccctctatatatatgttacatagaatgtatatatgttgggaacatgctcgcttctcccgtgtgtcgccgccgtgcgtcgtgcgcccgcaacagagccccaaccgggcctttgccgggtaaggggctaccgcgacgccacttgtccacgcagccaccaccggcccgggccagtccctgccagtccgtccgcctgtccgtccgtgtcctcagctctgtccacgcttcgataggcctgacgcagcccccagcccagggccgccctagcaacttcctgtacatatgactgtaaaatggtaaacgtgtgtattatatctggcctcgttatatagtgtatatatatgtatacatatacatatatataatatatatgaagactgtaaatgttaagacgactagtgttcttattagtatattgcttcacactgaagattgtgtgtatcgagctgtttctaaaagatgtttattttccttaagagtaaaaaacagtcattgcattcagaaaa

SEQ ID NO: 355281 - DNA, 7010 bp, Homo sapiens
gctgagatttagccgtgcgatgcccgcgcaggggcgggggccgcgggccaggggaggcgctcagagtccggagccgccgagcgagataaccagcccgagtcatgcagtcttttcgagaaaggtgtggtttccatggcaaacaacagaactaccagcagacctcgcaggaaacatcacgcctagagaattacaggcagccgagtcaggccgggctaagctgcgaccggcagcggctgctcgccaaggactattataacccgcagccttacccgagctatgagggtggcgctggcacgccctctggcactgcagccgcggtggccgccgacaagtaccaccgaggcagcaaggccctgcccacacagcaaggcctgcaggggaggccggctttccctggctacggcgtccaggacagcagcccctacccaggccgctatgctggtgaggagagccttcaggcttggggggccccacagccaccacccccacagccgcagccactacctgcaggggtggccaagtatgatgagaacttgatgaaaaagacagcagtgccccccagcaggcagtatgcagagcagggcgcccaggtgccctttcggactcactccctgcacgtccagcagccaccgccgccccagcagcccctggcataccccaagctccaaaggcagaagctgcagaacgacattgcctcccctctgcccttcccccagggtacccactttcctcagcattcccagtccttccccacctcctccacctactcctcctctgtccagggtggtgggcagggggcccactcctataagagttgcacagcaccgactgcccagccccatgacaggccgctgactgccagctccagcctggccccggggcagcgggtccagaatcttcatgcctaccagtcgggccgcctcagctatgaccagcagcagcagcagcagcagcagcagcagcagcagcagcaagcccttcagagccggcaccatgcccaggaaaccctccattaccaaaacctcgccaagtatcagcactacgggcagcaaggccagggctactgccagccggacgcagccgtccggaccccagagcagtactaccagaccttcagccccagctccagccactcacccgcccgctccgtgggccgctcaccttcctacagttccacaccgtcgccgctgatgccaaacctggagaactttccctacagccagcagccgctcagcaccggggccttccccgcagggatcactgaccacagccacttcatgcccctgctcaatccctccccaacggatgccaccagctctgtggacacccaggctggcaactgcaagccccttcagaaggacaagctccctgagaacctgctgtcggatctcagcctgcagagcctcacggcgctgacctcacaggtggagaacatctccaacaccgtccagcagctgctgctctccaaggctgctgtgccgcagaagaaaggtgtcaagaacctcgtgtccaggaccccagagcagcataaaagccagcactgcagccccgaagggagcggctactcagccgagcccgcaggcacaccgctgtcagagccgccgagcagcacgccacagtccacgcatgcggagccgcaggaggccgactacctgagcggctccgaggacccactggagcgcagcttcctctactgcaaccaggcccgtggcagccctgccagggtcaacagcaactcgaaggccaagcccgagtccgtgtccacctgttctgtgacctctcctgacgacatgtccaccaaatctgacgactccttccagagcctacacggcagtctgccgctcgacagcttctccaagttcgtggcgggtgagcgggactgtccgcggctgctgctcagcgccctggcacaggaggacctggcctccgagatcctggggctgcaggaagccatcggtgagaaggccgacaaagcttgggctgaagcacccagcctggtcaaggacagcagcaagccacccttctcgctggagaaccacagcgcctgcctggactctgtggccaagagtgcgtggccccggcctggggagccggaggccctgcccgactccttgcagctggacaagggcggcaatgccaaggacttcagcccagggctgtttgaagacccttccgtggccttcgctacgcctgaccccaaaaagacaactggtcctctctcctttggtaccaagcccacccttggggttcctgctccagaccccactacagcagcttttgactgtttcccggacacaaccgctgccagctcagcggacagcgccaacccctttgcctggccagaggaaaacctgggggatgcttgtcccaggtggggattgcaccctggcgagcttaccaagggcctggagcagggtgggaaggcctcagatggcatcagcaaaggggacacccatgaggcttcggcctgcctgggcttccaggaggaggacccccctggggagaaggtggcctcgttgcccggggacttcaagcaggaggaggtgggtggggtgaaggaggaggcaggtgggctgctgcagtgccccgaggtggccaaggctgaccggtggctggaggacagccggcactgctgttccaccgccgacttcggggacctcccactgctgccacccaccagcaggaaggaggacctggaagctgaggaggagtactcctccctatgtgagctcctgggcagccccgagcagaggcctggcatgcaggacccgctgtcacccaaggccccactcatctgcaccaaggaggaggtggaggaggtgctggactccaaggccggctggggctctccgtgccacctctcaggggagtccgtcatcctgctgggccctacagtgggcaccgagtcaaaggtccagagctggtttgagtcctctctgtcacacatgaagccaggtgaagaggggcctgatggggagcgagctccaggggattccaccacctcggacgcctctctggcccagaagcccaacaagcctgctgtgcccgaggcgcccatcgcaaagaaagagcctgtgccacggggcaaaagcttacggagccgtcgggtgcaccgggggctgcccgaggccgaggactccccatgcagggcaccagtgctgcccaaagacctcttgctccctgaatcctgcacagggcccccccagggacagatggaaggggctggagccccaggccggggggcctcggaagggctccccaggatgtgtactcgttctctcacggccctgagtgagccccgcacgcccggacccccaggcctgaccaccacccctgcacccccagacaaactggggggcaagcagcgagccgccttcaagtcgggcaagcgggtggggaagccctcacccaaggctgcctccagccccagcaacccggccgccctgcctgtggcctccgacagcagcccgatgggctccaagaccaaggagacagactcacccagcacgcctggcaaggaccagcgctccatgatccttcggtcacgcaccaaaacccaggagatcttccactccaagcggcggaggccctctgagggccggctccccaactgccgtgccaccaagaagctcctcgacaacagccacttgcccgccacattcaaggtctccagcagcccccagaaggagggcagggtgagccagcgggcaagggtccccaaacctggtgcaggcagcaagctctctgaccggcccctccatgcgctcaaaaggaagtcggccttcatggcgccggtccccaccaagaagcggaacctggtcttgcggagccgcagcagcagcagcagcaacgccagtggcaatgggggagatgggaaggaggagaggcctgagggttcccccaccctcttcaagaggatgtcttctcccaagaaagccaagcccaccaagggcaatggcgagcctgccacaaagctcccacccccggagacccccgatgcctgcctcaagctcgcctctcgggcagccttccagggggccatgaagaccaaggtgctgccaccccggaagggccggggcctgaagctggaagccatcgtgcagaagatcacctcgcccagcctcaagaagttcgcatgtaaagcgccaggggcctctcctggtaatcctctgagcccatccctttccgacaaagaccgtgggctcaagggtgctgggggcagcccagtgggggtggaagaaggcctggtaaatgtgggcaccgggcagaagctcccaacttctggggctgatccgttatgcagaaatccaaccaacagatccttaaaaggcaaactcatgaacagtaagaaactgtcttctactgactgtttcaaaaccgaggccttcacatccccggaggccctgcagcctggggggactgccctggcgcctaagaagaggagccggaaaggccgggcaggggcccatggactctccaaaggcccgctggagaagcggccctatcttggcccggctctgctcctgactccccgagacagggccagtggcacacaaggggccagtgaggacaactctggtggaggaggcaagaagccaaagatggaggagctgggcctggcctcccagcccccggagggcaggccctgccagccccagacaagggcacagaaacagccaggccacaccaactacagcagctattccaagcggaagcgcctcactcggggccgggccaagaacaccacctcttcaccctgtaaggggcgtgccaagcgacgacgacagcagcaggtgctgcccctggatcccgcagagcctgaaatccgcctcaagtacatttcctcttgcaagcggctgaggtcagacagccggacccccgccttctcacccttcgtgcgggtggagaagcgagacgcgttcaccaccatatgcactgttgtcaactcccctggagatgcgcccaagccccacaggaagccttcctcctctgcctcctcttcctcatcctcgtcctcgttctccttggatgcagccggggcctccctggccacactccctggaggctccatcctgcagccgcggccctccttgcccctctcctccacgatgcacttggggcctgtggtttccaaggccctgagtacctcttgccttgtttgctgcctctgccaaaacccggccaacttcaaggaccttggggacctctgtgggccctactaccctgaacactgcctccccaaaaagaagccaaaactcaaggagaaggtgcggccagaaggcacctgtgaggaggcctcgctgccgcttgagagaacactcaaaggtcccgagtgtgcagctgccgccactgccgggaagccccccaggcctgacggcccagctgacccggccaagcagggcccactgcgcaccagtgcccggggcctgtcccggaggctgcagagctgctactgctgtgatggccgggaggatgggggcgaggaggcagccccagccgacaagggtcgcaaacatgagtgcagcaaggaggctccggcagagcccggcggggaggcccaggagcactgggtgcatgaggcctgtgccgtgtggaccggcggcgtctacctggtggccgggaagctctttgggctgcaggaggccatgaaggtggccgtggacatgatgtgttccagctgccaagaagccggggccaccattgggtgctgccacaaaggatgcctccacacctaccactacccgtgtgccagcgatgcaggttgcatattcatcgaagagaacttttctttgaaatgtcccaaacataagaggctgccgtagtaatccaccccaacggccggaggagccgccggagcccgcctgcccgcccgccgccgaaggagaggagccgcctgcgcagcccccgggcctttgagctgctcccagcgctggtccagagccgatccttgatccgggtcccggatcgtggatccggccgcctagggctcagacttgcggccccgggttgggaggaaaacccgttccggagccgcctgctcccggaaccggacggcacagggcgttcttgcccaccccaggggccaggcttgcggagggggagcccgcggagcggccagactccccggggcgctcagcctccggcgagggtgggagacggctttgtcctggggacactttccctctggaatctcaagacgacgtggcacacattccacgtgggtgctgccgccaccccagtcggtcgtggcgtgcagctgggagccctgggcttgggggtgggggtcgaaacagtactggaagaggcggagggcggctcctagctccgtggactaggcgggggagaaaggaagcctttctgagagcgggctaggccggcactggagaggccggagcctttggaacaaaccgtgcggaacgccgaccgttgtgcaccaccagggaccgccgcgcctactctgcacgggagcagggacagcgctagatttcgtgtacaaaacctgtgtacccctctatatatatgttacatagaatgtatatatgttgggaacatgctcgcttctcccgtgtgtcgccgccgtgcgtcgtgcgcccgcaacagagccccaaccgggcctttgccgggtaaggggctaccgcgacgccacttgtccacgcagccaccaccggcccgggccagtccctgccagtccgtccgcctgtccgtccgtgtcctcagctctgtccacgcttcgataggcctgacgcagcccccagcccagggccgccctagcaacttcctgtacatatgactgtaaaatggtaaacgtgtgtattatatctggcctcgttatatagtgtatatatatgtatacatatacatatatataatatatatgaagactgtaaatgttaagacgactagtgttcttattagtatattgcttcacactgaagattgtgtgtatcgagctgtttctaaaagatgtttattttccttaagagtaaaaaacagtcattgcattcagaaaa

SEQ ID NO: 355282 - DNA, 1766 bp, Homo sapiens
tcttgctctccttctccccccgcgcgtcgcccgcccgcccgtccgctcgtccgctcttcctgtgcggaggggatcgcattcctcgcggcacccgcggacaccaggcaggcccggccgggtgcgcggccaaggcccgctccccgcgtccccgggcgccgcccccgcccgcggctgggctccgagagacgagtgggagagcgagtgcagcgagggcgagaggcgagccgagcaggccgccctgcccgcggccctagcgccggcgcgaggagggggcgccgcggcccaccctccttcctgcctggccgcgggccggccgggccgccgcgccccgacccccatggccacccaggcctccgggccgcgaagtcgcagcgccagacccaaggcccccgagtgagcgcgggcgccgaggcaagccggtatattcggggcccaggagcaaggaaaagtggccttttgcgtgacacagaagtggacacatcattctgatctcagggcaggctcagccccataactctggcaaaagctctcacaagcaaaagccttggagaggaggagaatgtatcaaggtgagatccaggccccagaagccaactgtggagtgggcaaaataggacctttcccaccagcctagcatccctctggcttctgtggagataaagggaactcaggggtactggagctgcctttctcttccactagactgtggggctctcataggcagggaccctgtcttactcctctttgttttatttttgagacagggtcttgctgtgtggcccaggctggagtgccttggcacaaacacagctcacttcagcctcaacctccagggctcaagcgatcctccagcatcagtctcctgagtagctgggatcacaggcgcccgacaccacacgtagctaattttaaatttttttttttttctagagacaggggtcttgccatggctggtcttgaagtcctgggctcaagcgatcctccctctttggcctcccaaagtgctgggattacaggagtgagtcactgcacccagccttactcctctttagactcccaagcctagaccaatggctttcaaattcttgcccgtgacctatagtaagaaatacatcgtaggtaactacacaggtcacactgtatatagctgaaacaaaagtttactgaaataactcccttactgtgtctgctggtctgtaatcctttttgttcttgtgtatttgttttttttttaattactgattgctacccacgaaattaattttgcaatccactgatgggtcatacccagaatttgaaaaaaacaagcctaggaaatgaatttgccatctattcatgcaacaaatgttaattgcaaccctaataattcctctcatgttaaactactcaagtaacacttggatacttgggtgaaaaatgcaaataagccagaaatatatgtagtaaaagtaaaagttcccttggcaccctccctgcaggtaaccccagttaatagtttgaacgtatccttccagactttttgttactcacttaatgcatatatatatatatatatgtatgtatgtatgtatattacatataccaatccatgcatagttttctttttccccaagtgaggacatactgtgggctcttcctcggcagcttcctttttcctctccgtttgtcttggagaggttggttgtgtggcgaagtccttcagggcaagttctgggttgactcctggctccaccacatactgaacaggccatttacctctctgtgcc

SEQ ID NO: 355283 - DNA, 6010 bp, Homo sapiens
tcttgctctccttctccccccgcgcgtcgcccgcccgcccgtccgctcgtccgctcttcctgtgcggaggggatcgcattcctcgcggcacccgcggacaccaggcaggcccggccgggtgcgcggccaaggcccgctccccgcgtccccgggcgccgcccccgcccgcggctgggctccgagagacgagtgggagagcgagtgcagcgagggcgagaggcgagccgagcaggccgccctgcccgcggccctagcgccggcgcgaggagggggcgccgcggcccaccctccttcctgcctggccgcgggccggccgggccgccgcgccccgacccccatggccacccaggcctccgggccgcgaagtcgcagcgccagacccaaggcccccgagtgagcgcgggcgccgaggatctcatctggccaccgcgttctggaagaggcgagagggagagcgtgcgcgagaggagagagacggcgggggaaagggagacggcgagacgcgcagcgccggcgcccgggagacccaggaggagcccgcagataaccagcccgagtcatgcagtcttttcgagaaaggtgtggtttccatggcaaacaacagaactaccagcagacctcgcaggaaacatcacgcctagagaattacaggcagccgagtcaggccgggctaagctgcgaccggcagcggctgctcgccaaggactattataacccgcagccttacccgagctatgagggtggcgctggcacgccctctggcactgcagccgcggtggccgccgacaagtaccaccgaggcagcaaggccctgcccacacagcaaggcctgcaggggaggccggctttccctggctacggcgtccaggacagcagcccctacccaggccgctatgctggtgaggagagccttcaggcttggggggccccacagccaccacccccacagccgcagccactacctgcaggggtggccaagtatgatgagaacttgatgaaaaagacagcagtgccccccagcaggcagtatgcagagcagggcgcccaggtgccctttcggactcactccctgcacgtccagcagccaccgccgccccagcagcccctggcataccccaagctccaaaggcagaagctgcagaacgacattgcctcccctctgcccttcccccagggtacccactttcctcagcattcccagtccttccccacctcctccacctactcctcctctgtccagggtggtgggcagggggcccactcctataagagttgcacagcaccgactgcccagccccatgacaggccgctgactgccagctccagcctggccccggggcagcgggtccagaatcttcatgcctaccagtcgggccgcctcagctatgaccagcagcagcagcagcagcagcagcagcagcagcagcagcaagcccttcagagccggcaccatgcccaggaaaccctccattaccaaaacctcgccaagtatcagcactacgggcagcaaggccagggctactgccagccggacgcagccgtccggaccccagagcagtactaccagaccttcagccccagctccagccactcacccgcccgctccgtgggccgctcaccttcctacagttccacaccgtcgccgctgatgccaaacctggagaactttccctacagccagcagccgctcagcaccggggccttccccgcagggatcactgaccacagccacttcatgcccctgctcaatccctccccaacggatgccaccagctctgtggacacccaggctggcaactgcaagccccttcagaaggacaagctccctgagaacctgctgtcggatctcagcctgcagagcctcacggcgctgacctcacaggtggagaacatctccaacaccgtccagcagctgctgctctccaaggctgctgtgccgcagaagaaaggtgtcaagaacctcgtgtccaggaccccagagcagcataaaagccagcactgcagccccgaagggagcggctactcagccgagcccgcaggcacaccgctgtcagagccgccgagcagcacgccacagtccacgcatgcggagccgcaggaggccgactacctgagcggctccgaggacccactggagcgcagcttcctctactgcaaccaggcccgtggcagccctgccagggtcaacagcaactcgaaggccaagcccgagtccgtgtccacctgttctgtgacctctcctgacgacatgtccaccaaatctgacgactccttccagagcctacacggcagtctgccgctcgacagcttctccaagttcgtggcgggtgagcgggactgtccgcggctgctgctcagcgccctggcacaggaggacctggcctccgagatcctggggctgcaggaagccatcggtgagaaggccgacaaagcttgggctgaagcacccagcctggtcaaggacagcagcaagccacccttctcgctggagaaccacagcgcctgcctggactctgtggccaagagtgcgtggccccggcctggggagccggaggccctgcccgactccttgcagctggacaagggcggcaatgccaaggacttcagcccagggctgtttgaagacccttccgtggccttcgctacgcctgaccccaaaaagacaactggtcctctctcctttggtaccaagcccacccttggggttcctgctccagaccccactacagcagcttttgactgtttcccggacacaaccgctgccagctcagcggacagcgccaacccctttgcctggccagaggaaaacctgggggatgcttgtcccaggtggggattgcaccctggcgagcttaccaagggcctggagcagggtgggaaggcctcagatggcatcagcaaaggggacacccatgaggcttcggcctgcctgggcttccaggaggaggacccccctggggagaaggtggcctcgttgcccggggacttcaagcaggaggaggtgggtggggtgaaggaggaggcaggtgggctgctgcagtgccccgaggtggccaaggctgaccggtggctggaggacagccggcactgctgttccaccgccgacttcggggacctcccactgctgccacccaccagcaggaaggaggacctggaagctgaggaggagtactcctccctatgtgagctcctgggcagccccgagcagaggcctggcatgcaggacccgctgtcacccaaggccccactcatctgcaccaaggaggaggtggaggaggtgctggactccaaggccggctggggctctccgtgccacctctcaggggagtccgtcatcctgctgggccctacagtgggcaccgagtcaaaggtccagagctggtttgagtcctctctgtcacacatgaagccaggtgaagaggggcctgatggggagcgagctccaggggattccaccacctcggacgcctctctggcccagaagcccaacaagcctgctgtgcccgaggcgcccatcgcaaagaaagagcctgtgccacggggcaaaagcttacggagccgtcgggtgcaccgggggctgcccgaggccgaggactccccatgcagggcaccagtgctgcccaaagacctcttgctccctgaatcctgcacagggcccccccagggacagatggaaggggctggagccccaggccggggggcctcggaagggctccccaggatgtgtactcgttctctcacggccctgagtgagccccgcacgcccggacccccaggcctgaccaccacccctgcacccccagacaaactggggggcaagcagcgagccgccttcaagtcgggcaagcgggtggggaagccctcacccaaggctgcctccagccccagcaacccggccgccctgcctgtggcctccgacagcagcccgatgggctccaagaccaaggagacagactcacccagcacgcctggcaaggaccagcgctccatgatccttcggtcacgcaccaaaacccaggagatcttccactccaagcggcggaggccctctgagggccggctccccaactgccgtgccaccaagaagctcctcgacaacagccacttgcccgccacattcaaggtctccagcagcccccagaaggagggcagggtgagccagcgggcaagggtccccaaacctggtgcaggcagcaagctctctgaccggcccctccatgcgctcaaaaggaagtcggccttcatggcgccggtccccaccaagaagcggaacctggtcttgcggagccgcagcagcagcagcagcaacgccagtggcaatgggggagatgggaaggaggagaggcctgagggttcccccaccctcttcaagaggatgtcttctcccaagaaagccaagcccaccaagggcaatggcgagcctgccacaaagctcccacccccggagacccccgatgcctgcctcaagctcgcctctcgggcagccttccagggggccatgaagaccaaggtgctgccaccccggaagggccggggcctgaagctggaagccatcgtgcagaagatcacctcgcccagcctcaagaagttcgcatgtaaagcgccaggggcctctcctggtaatcctctgagcccatccctttccgacaaagaccgtgggctcaagggtgctgggggcagcccagtgggggtggaagaaggcctggtaaatgtgggcaccgggcagaagctcccaacttctggggctgatccgttatgcagaaatccaaccaacagatccttaaaaggcaaactcatgaacagtaagaaactgtcttctactgactgtttcaaaaccgaggccttcacatccccggaggccctgcagcctggggggactgccctggcgcctaagaagaggagccggaaaggccgggcaggggcccatggactctccaaaggcccgctggagaagcggccctatcttggcccggctctgctcctgactccccgagacagggccagtggcacacaaggggccagtgaggacaactctggtggaggaggcaagaagccaaagatggaggagctgggcctggcctcccagcccccggagggcaggccctgccagccccagacaagggcacagaaacagccaggccacaccaactacagcagctattccaagcggaagcgcctcactcggggccgggccaagaacaccacctcttcaccctgtaaggggcgtgccaagcgacgacgacagcagcaggtgctgcccctggatcccgcagagcctgaaatccgcctcaagtacatttcctcttgcaagcggctgaggtcagacagccggacccccgccttctcaccccctggagcccagcctgggagcgcaaaacccaagaagcggccagaacgcacctccggctccggcggacgcgcgaccgttgtgcaccaccagggaccgccgcgcctactctgcacgggagcagggacagcgctagatttcgtgtacaaaacctgtgtacccctctatatatatgttacatagaatgtatatatgttgggaacatgctcgcttctcccgtgtgtcgccgccgtgcgtcgtgcgcccgcaacagagccccaaccgggcctttgccgggtaaggggctaccgcgacgccacttgtccacgcagccaccaccggcccgggccagtccctgccagtccgtccgcctgtccgtccgtgtcctcagctctgtccacgcttcgataggcctgacgcagcccccagcccagggccgccctagcaacttcctgtacatatgactgtaaaatggtaaacgtgtgtattatatctggcctcgttatatagtgtatatatatgtatacatatacatatatataatatatatgaagactgtaaatgttaagacgactagtgttcttattagtatattgcttcacactgaagattgtgtgtatcgagctgtttctaaaagatgtttattttccttaagagtaaaaaacagtcattgcattcagaaaa

SEQ ID NO: 355284 - DNA, 6335 bp, Homo sapiens
cgccccacagacggcggcgcagcccgccgcccttttcgaggccggccccccctctcacgcgccttgaaggcaagccggtatattcggggcccaggagcaaggaaaagtggccttttgcgtgacacagaagtggacacatcattctgatctcagggcaggctcagccccataactctggcaaaagctctcacaagcaaaagccttggagaggaggagaatgtatcaaggatctcatctggccaccgcgttctggaagaggcgagagggagagcgtgcgcgagaggagagagacggcgggggaaagggagacggcgagacgcgcagcgccggcgcccgggagacccaggaggagcccgcagataaccagcccgagtcatgcagtcttttcgagaaaggtgtggtttccatggcaaacaacagaactaccagcagacctcgcaggaaacatcacgcctagagaattacaggcagccgagtcaggccgggctaagctgcgaccggcagcggctgctcgccaaggactattataacccgcagccttacccgagctatgagggtggcgctggcacgccctctggcactgcagccgcggtggccgccgacaagtaccaccgaggcagcaaggccctgcccacacagcaaggcctgcaggggaggccggctttccctggctacggcgtccaggacagcagcccctacccaggccgctatgctggtgaggagagccttcaggcttggggggccccacagccaccacccccacagccgcagccactacctgcaggggtggccaagtatgatgagaacttgatgaaaaagacagcagtgccccccagcaggcagtatgcagagcagggcgcccaggtgccctttcggactcactccctgcacgtccagcagccaccgccgccccagcagcccctggcataccccaagctccaaaggcagaagctgcagaacgacattgcctcccctctgcccttcccccaggggtggtgggcagggggcccactcctataagagttgcacagcaccgactgcccagccccatgacaggccgctgactgccagctccagcctggccccggggcagcgggtccagaatcttcatgcctaccagtcgggccgcctcagctatgaccagcagcagcagcagcagcagcagcagcagcagcagcagcaagcccttcagagccggcaccatgcccaggaaaccctccattaccaaaacctcgccaagtatcagcactacgggcagcaaggccagggctactgccagccggacgcagccgtccggaccccagagcagtactaccagaccttcagccccagctccagccactcacccgcccgctccgtgggccgctcaccttcctacagttccacaccgtcgccgctgatgccaaacctggagaactttccctacagccagcagccgctcagcaccggggccttccccgcagggatcactgaccacagccacttcatgcccctgctcaatccctccccaacggatgccaccagctctcctgcagagcctcacggcgctgacctcacaggtggagaacatctccaacaccgtccagcagctgctgctctccaaggctgctgtgccgcagaagaaaggtgtcaagaacctcgtgtccaggaccccagagcagcataaaagccagcactgcagccccgaagggagcggctactcagccgagcccgcaggcacaccgctgtcagagccgccgagcagcacgccacagtccacgcatgcggagccgcaggaggccgactacctgagcggctccgaggacccactggagcgcagcttcctctactgcaaccaggcccgtggcagccctgccagggtcaacagcaactcgaaggccaagcccgagtccgtgtccacctgttctgtgacctctcctgacgacatgtccaccaaatctgacgactccttccagagcctacacggcagtctgccgctcgacagcttctccaagttcgtggcgggtgagcgggactgtccgcggctgctgctcagcgccctggcacaggaggacctggcctccgagatcctggggctgcaggaagccatcggtgagaaggccgacaaagcttgggctgaagcacccagcctggtcaaggacagcagcaagccacccttctcgctggagaaccacagcgcctgcctggactctgtggccaagagtgcgtggccccggcctggggagccggaggccctgcccgactccttgcagctggacaagggcggcaatgccaaggacttcagcccagggctgtttgaagacccttccgtggccttcgctacgcctgaccccaaaaagacaactggtcctctctcctttggtaccaagcccacccttggggttcctgctccagaccccactacagcagcttttgactgtttcccggacacaaccgctgccagctcagcggacagcgccaacccctttgcctggccagaggaaaacctgggggatgcttgtcccaggtggggattgcaccctggcgagcttaccaagggcctggagcagggtgggaaggcctcagatggcatcagcaaaggggacacccatgaggcttcggcctgcctgggcttccaggaggaggacccccctggggagaaggtggcctcgttgcccggggacttcaagcaggaggaggtgggtggggtgaaggaggaggcaggtgggctgctgcagtgccccgaggtggccaaggctgaccggtggctggaggacagccggcactgctgttccaccgccgacttcggggacctcccactgctgccacccaccagcaggaaggaggacctggaagctgaggaggagtactcctccctatgtgagctcctgggcagccccgagcagaggcctggcatgcaggacccgctgtcacccaaggccccactcatctgcaccaaggaggaggtggaggaggtgctggactccaaggccggctggggctctccgtgccacctctcaggggagtccgtcatcctgctgggccctacagtgggcaccgagtcaaaggtccagagctggtttgagtcctctctgtcacacatgaagccaggtgaagaggggcctgatggggagcgagctccaggggattccaccacctcggacgcctctctggcccagaagcccaacaagcctgctgtgcccgaggcgcccatcgcaaagaaagagcctgtgccacggggcaaaagcttacggagccgtcgggtgcaccgggggctgcccgaggccgaggactccccatgcagggcaccagtgctgcccaaagacctcttgctccctgaatcctgcacagggcccccccagggacagatggaaggggctggagccccaggccggggggcctcggaagggctccccaggatgtgtactcgttctctcacggccctgagtgagccccgcacgcccggacccccaggcctgaccaccacccctgcacccccagacaaactggggggcaagcagcgagccgccttcaagtcgggcaagcgggtggggaagccctcacccaaggctgcctccagccccagcaacccggccgccctgcctgtggcctccgacagcagcccgatgggctccaagaccaaggagacagactcacccagcacgcctggcaaggaccagcgctccatgatccttcggtcacgcaccaaaacccaggagatcttccactccaagcggcggaggccctctgagggccggctccccaactgccgtgccaccaagaagctcctcgacaacagccacttgcccgccacattcaaggtctccagcagcccccagaaggagggcagggtgagccagcgggcaagggtccccaaacctggtgcaggcagcaagctctctgaccggcccctccatgcgctcaaaaggaagtcggccttcatggcgccggtccccaccaagaagcggaacctggtcttgcggagccgcagcagcagcagcagcaacgccagtggcaatgggggagatgggaaggaggagaggcctgagggttcccccaccctcttcaagaggatgtcttctcccaagaaagccaagcccaccaagggcaatggcgagcctgccacaaagctcccacccccggagacccccgatgcctgcctcaagctcgcctctcgggcagccttccagggggccatgaagaccaaggtgctgccaccccggaagggccggggcctgaagctggaagccatcgtgcagaagatcacctcgcccagcctcaagaagttcgcatgtaaagcgccaggggcctctcctggtaatcctctgagcccatccctttccgacaaagaccgtgggctcaagggtgctgggggcagcccagtgggggtggaagaaggcctggtaaatgtgggcaccgggcagaagctcccaacttctggggctgatccgttatgcagaaatccaaccaacagatccttaaaaggcaaactcatgaacaagggccagtggcacacaaggggccagtgaggacaactctggtggaggaggcaagaagccaaagatggaggagctgggcctggcctcccagcccccggagggcaggccctgccagccccagacaagggcacagaaacagccaggccacaccaactacagcagctattccaagcggaagcgcctcactcggggccgggccaagaacaccacctcttcaccctgtaaggggcgtgccaagcgacgacgacagcagcaggtgctgcccctggatcccgcagagcctgaaatccgcctcaagtacatttcctcttgcaagcggctgaggtcagacagccggacccccgccttctcacccttcgtgcgggtggagaagcgagacgcgttcaccaccatatgcactgttgtcaactcccctggagatgcgcccaagccccacaggaagccttcctcctctgcctcctcttcctcatcctcgtcctcgttctccttggatgcagccggggcctccctggccacactccctggaggctccatcctgcagccgcggccctccttgcccctctcctccacgatgcacttggggcctgtggtttccaaggccctgagtacctcttgccttgtttgctgcctctgccaaaacccggccaacttcaaggaccttggggacctctgtgggccctactaccctgaacactgcctccccaaaaagaagccaaaactcaaggagaaggtgcggccagaaggcacctgtgaggaggcctcgctgccgcttgagagaacactcaaaggtcccgagtgtgcagctgccgccactgccgggaagccccccaggcctgacggcccagctgacccggccaagcagggcccactgcgcaccagtgcccggggcctgtcccggaggctgcagagctgctactgctgtgatggccgggaggatgggggcgaggaggcagccccagccgacaagggagcactgggtgcatgaggcctgtgccgtgtggaccggcggcgtctacctggtggccgggaagctctttgggctgcaggaggccatgaaggtggccgtggacatgcacggtggcactgtggctctggcgcctggtgacttctccctccccggcctcaggtttgcttcactcttccaagggccttcttggtgtgactgtcctgtcctggccacgtccactccaagcagctggtccagatgtgttccagctgccaagaagccggggccaccattgggtgctgccacaaaggatgcctccacacctaccactacccgtgtgccagcgatgcaggtacgagcccgcccaggaacaggagggcattggagcccatccaagcagtccagggggaccctccctgggcacagctccccaaacccaggccccatctcactcttcagtttccctcctctcttgccccagcaattcttttatccttctgtctgcctagacctctgctgggcaatgccagggacatggaaatgaggcattccccaggcacctgcttgaggagtgcccagagcagtgagggaagatagaagcataaattacaatgtggaatgctgtctgcggagccatcattgccaaggggcagggaggatctcaggcctcagagagaaaggggtattggaggttgggcctttgaaggataaataggagttcactcagcagagacaaggggaaaggcactactacaacagcaaaaaccaactgagttgggggtgatgaggttcaaaacagactgagacccatggagcaattgtggaagttttgaagcagggtaatggggtatggaggtaggcccaggctccccgcatcctctccccggtccttcctctcactcatgtattca

SEQ ID NO: 355285 - DNA, 1596 bp, Homo sapiens
gtctggagcctcgcgggcagtgcggctcccctcctggctgcagacaaaaccccacagctgtggggcccccaccctgtcctaaccaccgaaacttctctttggtcacaggttgcatattcatcgaagagaacttttctttgaaatgtcccaaacataagaggctgccgtagtaatccaccccaacggccggaggagccgccggagcccgcctgcccgcccgccgccgaaggagaggagccgcctgcgcagcccccgggcctttgagctgctcccagcgctggtccagagccgatccttgatccgggtcccggatcgtggatccggccgcctagggctcagacttgcggccccgggttgggaggaaaacccgttccggagccgcctgctcccggaaccggacggcacagggcgttcttgcccaccccaggggccaggcttgcggagggggagcccgcggagcggccagactccccggggcgctcagcctccggcgagggtgggagacggctttgtcctggggacactttccctctggaatctcaagacgacgtggcacacattccacgtgggtgctgccgccaccccagtcggtcgtggcgtgcagctgggagccctgggcttgggggtgggggtcgaaacagtactggaagaggcggagggcggctcctagctccgtggactaggcgggggagaaaggaagcctttctgagagcgggctaggccggcactggagaggccggagcctttggaacaaaccgtgcggaacgcgtccaggggccttcccgcccagcctttgccagatctctcgtgcggttcgggcaaagccggggtagacctgggctatgctcagttaggggttgcgggatccccgagtgtgggcgggactgggacaccctttggcctctgtttgtcccctttccagtcctccaccccacccctggagcccagcctgggagcgcaaaacccaagaagcggccagaacgcacctccggctccggcggacgcgcgaccgttgtgcaccaccagggaccgccgcgcctactctgcacgggagcagggacagcgctagatttcgtgtacaaaacctgtgtacccctctatatatatgttacatagaatgtatatatgttgggaacatgctcgcttctcccgtgtgtcgccgccgtgcgtcgtgcgcccgcaacagagccccaaccgggcctttgccgggtaaggggctaccgcgacgccacttgtccacgcagccaccaccggcccgggccagtccctgccagtccgtccgcctgtccgtccgtgtcctcagctctgtccacgcttcgataggcctgacgcagcccccagcccagggccgccctagcaacttcctgtacatatgactgtaaaatggtaaacgtgtgtattatatctggcctcgttatatagtgtatatatatgtatacatatacatatatataatatatatgaagactgtaaatgttaagacgactagtgttcttattagtatattgcttcacactgaagattgtgtgtatcgagctgtttctaaaagatgtttattttccttaagagtaaaaaacagtcattgcattcagaaaa

SEQ ID NO: 355286 - DNA, 6749 bp, Homo sapiens
gctgagatttagccgtgcgatgcccgcgcaggggcgggggccgcgggccaggggaggcgctcagagtccggagccgccgagcgagataaccagcccgagtcatgcagtcttttcgagaaaggtgtggtttccatggcaaacaacagaactaccagcagacctcgcaggaaacatcacgcctagagaattacaggcagccgagtcaggccgggctaagctgcgaccggcagcggctgctcgccaaggactattataacccgcagccttacccgagctatgagggtggcgctggcacgccctctggcactgcagccgcggtggccgccgacaagtaccaccgaggcagcaaggccctgcccacacagcaaggcctgcaggggaggccggctttccctggctacggcgtccaggacagcagcccctacccaggccgctatgctggtgaggagagccttcaggcttggggggccccacagccaccacccccacagccgcagccactacctgcaggggtggccaagtatgatgagaacttgatgaaaaagacagcagtgccccccagcaggcagtatgcagagcagggcgcccaggtgccctttcggactcactccctgcacgtccagcagccaccgccgccccagcagcccctggcataccccaagctccaaaggcagaagctgcagaacgacattgcctcccctctgcccttcccccagggtacccactttcctcagcattcccagtccttccccacctcctccacctactcctcctctgtccagggtggtgggcagggggcccactcctataagagttgcacagcaccgactgcccagccccatgacaggccgctgactgccagctccagcctggccccggggcagcgggtccagaatcttcatgcctaccagtcgggccgcctcagctatgaccagcagcagcagcagcagcagcagcagcagcagcagcagcaagcccttcagagccggcaccatgcccaggaaaccctccattaccaaaacctcgccaagtatcagcactacgggcagcaaggccagggctactgccagccggacgcagccgtccggaccccagagcagtactaccagaccttcagccccagctccagccactcacccgcccgctccgtgggccgctcaccttcctacagttccacaccgtcgccgctgatgccaaacctggagaactttccctacagccagcagccgctcagcaccggggccttccccgcagggatcactgaccacagccacttcatgcccctgctcaatccctccccaacggatgccaccagctctgtggacacccaggctggcaactgcaagccccttcagaaggacaagctccctgagaacctgctgtcggatctcagcctgcagagcctcacggcgctgacctcacaggtggagaacatctccaacaccgtccagcagctgctgctctccaaggctgctgtgccgcagaagaaaggtgtcaagaacctcgtgtccaggaccccagagcagcataaaagccagcactgcagccccgaagggagcggctactcagccgagcccgcaggcacaccgctgtcagagccgccgagcagcacgccacagtccacgcatgcggagccgcaggaggccgactacctgagcggctccgaggacccactggagcgcagcttcctctactgcaaccaggcccgtggcagccctgccagggtcaacagcaactcgaaggccaagcccgagtccgtgtccacctgttctgtgacctctcctgacgacatgtccaccaaatctgacgactccttccagagcctacacggcagtctgccgctcgacagcttctccaagttcgtggcgggtgagcgggactgtccgcggctgctgctcagcgccctggcacaggaggacctggcctccgagatcctggggctgcaggaagccatcggtgagaaggccgacaaagcttgggctgaagcacccagcctggtcaaggacagcagcaagccacccttctcgctggagaaccacagcgcctgcctggactctgtggccaagagtgcgtggccccggcctggggagccggaggccctgcccgactccttgcagctggacaagggcggcaatgccaaggacttcagcccagggctgtttgaagacccttccgtggccttcgctacgcctgaccccaaaaagacaactggtcctctctcctttggtaccaagcccacccttggggttcctgctccagaccccactacagcagcttttgactgtttcccggacacaaccgctgccagctcagcggacagcgccaacccctttgcctggccagaggaaaacctgggggatgcttgtcccaggtggggattgcaccctggcgagcttaccaagggcctggagcagggtgggaaggcctcagatggcatcagcaaaggggacacccatgaggcttcggcctgcctgggcttccaggaggaggacccccctggggagaaggtggcctcgttgcccggggacttcaagcaggaggaggtgggtggggtgaaggaggaggcaggtgggctgctgcagtgccccgaggtggccaaggctgaccggtggctggaggacagccggcactgctgttccaccgccgacttcggggacctcccactgctgccacccaccagcaggaaggaggacctggaagctgaggaggagtactcctccctatgtgagctcctgggcagccccgagcagaggcctggcatgcaggacccgctgtcacccaaggccccactcatctgcaccaaggaggaggtggaggaggtgctggactccaaggccggctggggctctccgtgccacctctcaggggagtccgtcatcctgctgggccctacagtgggcaccgagtcaaaggtccagagctggtttgagtcctctctgtcacacatgaagccaggtgaagaggggcctgatggggagcgagctccaggggattccaccacctcggacgcctctctggcccagaagcccaacaagcctgctgtgcccgaggcgcccatcgcaaagaaagagcctgtgccacggggcaaaagcttacggagccgtcgggtgcaccgggggctgcccgaggccgaggactccccatgcagggcaccagtgctgcccaaagacctcttgctccctgaatcctgcacagggcccccccagggacagatggaaggggctggagccccaggccggggggcctcggaagggctccccaggatgtgtactcgttctctcacggccctgagtgagccccgcacgcccggacccccaggcctgaccaccacccctgcacccccagacaaactggggggcaagcagcgagccgccttcaagtcgggcaagcgggtggggaagccctcacccaaggctgcctccagccccagcaacccggccgccctgcctgtggcctccgacagcagcccgatgggctccaagaccaaggagacagactcacccagcacgcctggcaaggaccagcgctccatgatccttcggtcacgcaccaaaacccaggagatcttccactccaagcggcggaggccctctgagggccggctccccaactgccgtgccaccaagaagctcctcgacaacagccacttgcccgccacattcaaggtctccagcagcccccagaaggagggcagggtgagccagcgggcaagggtccccaaacctggtgcaggcagcaagctctctgaccggcccctccatgcgctcaaaaggaagtcggccttcatggcgccggtccccaccaagaagcggaacctggtcttgcggagccgcagcagcagcagcagcaacgccagtggcaatgggggagatgggaaggaggagaggcctgagggttcccccaccctcttcaagaggatgtcttctcccaagaaagccaagcccaccaagggcaatggcgagcctgccacaaagctcccacccccggagacccccgatgcctgcctcaagctcgcctctcgggcagccttccagggggccatgaagaccaaggtgctgccaccccggaagggccggggcctgaagctggaagccatcgtgcagaagatcacctcgcccagcctcaagaagttcgcatgtaaagcgccaggggcctctcctggtaatcctctgagcccatccctttccgacaaagaccgtgggctcaagggtgctgggggcagcccagtgggggtggaagaaggcctggtaaatgtgggcaccgggcagaagctcccaacttctggggctgatccgttatgcagaaatccaaccaacagatccttaaaaggcaaactcatgaacagtaagaaactgtcttctactgactgtttcaaaaccgaggccttcacatccccggaggccctgcagcctggggggactgccctggcgcctaagaagaggagccggaaaggccgggcaggggcccatggactctccaaaggcccgctggagaagcggccctatcttggcccggctctgctcctgactccccgagacagggccagtggcacacaaggggccagtgaggacaactctggtggaggaggcaagaagccaaagatggaggagctgggcctggcctcccagcccccggagggcaggccctgccagccccagacaagggcacagaaacagccaggccacaccaactacagcagctattccaagcggaagcgcctcactcggggccgggccaagaacaccacctcttcaccctgtaaggggcgtgccaagcgacgacgacagcagcaggtgctgcccctggatcccgcagagcctgaaatccgcctcaagtacatttcctcttgcaagcggctgaggtcagacagccggacccccgccttctcacccttcgtgcgggtggagaagcgagacgcgttcaccaccatatgcactgttgtcaactcccctggagatgcgcccaagccccacaggaagccttcctcctctgcctcctcttcctcatcctcgtcctcgttctccttggatgcagccggggcctccctggccacactccctggaggctccatcctgcagccgcggccctccttgcccctctcctccacgatgcacttggggcctgtggtttccaaggccctgagtacctcttgccttgtttgctgcctctgccaaaacccggccaacttcaaggaccttggggacctctgtgggccctactaccctgaacactgcctccccaaaaagaagccaaaactcaaggagaaggtgcggccagaaggcacctgtgaggaggcctcgctgccgcttgagagaacactcaaaggtcccgagtgtgcagctgccgccactgccgggaagccccccaggcctgacggcccagctgacccggccaagcagggcccactgcgcaccagtgcccggggcctgtcccggaggctgcagagctgctactgctgtgatggccgggaggatgggggcgaggaggcagccccagccgacaagggtcgcaaacatgagtgcagcaaggaggctccggcagagcccggcggggaggcccaggagcactgggtgcatgaggcctgtgccgtgtggaccggcggcgtctacctggtggccgggaagctctttgggctgcaggaggccatgaaggtggccgtggacatgatgtgttccagctgccaagaagccggggccaccattgggtgctgccacaaaggatgcctccacacctaccactacccgtgtgccagcgatgcaggttgcatattcatcgaagagaacttttctttgaaatgtcccaaacataagaggctgccgtagtaatccaccccaacggccggaggagccgccggagcccgcctgcccgcccgccgccgaaggagaggagccgcctgcgcagcccccgggcctttgagctgctcccagcgctggtccagagccgatccttgatccgggtcccggatcgtggatccggccgcctagggctcagacttgcggccccgggttgggaggaaaacccgttccggagccgcctgctcccggaaccggacggcacagggcgttcttgcccaccccaggggccaggcttgcggagggggagcccgcggagcggccagactccccggggcgctcagcctccggcgagggtgggagacggctttgtcctggggacactttccctctggaatctcaagacgacgtggcacacattccacgtgggtgctgccgccaccccagtcggtcgtggcgtgcagctgggagccctgggcttgggggtgggggtcgaaacagtactggaagaggcggagggcggctcctagctccgtggactaggcgggggagaaaggaagcctttgccgggtaaggggctaccgcgacgccacttgtccacgcagccaccaccggcccgggccagtccctgccagtccgtccgcctgtccgtccgtgtcctcagctctgtccacgcttcgataggcctgacgcagcccccagcccagggccgccctagcaacttcctgtacatatgactgtaaaatggtaaacgtgtgtattatatctggcctcgttatatagtgtatatatatgtatacatatacatatatataatatatatgaagactgtaaatgttaagacgactagtgttcttattagtatattgcttcacactgaagattgtgtgtatcgagctgtttctaaaagatgtttattttccttaagagtaaaaaacagtcattgcattcagaaaa

SEQ ID NO: 355287 - DNA, 4609 bp, Homo sapiens
gtcagctgatgggctgcctgccgaggaggccgcagcagtcgccgcgcgaacatggcggccgaaatccactccaggccgcagagcagccgcccggtgctgctgagcaagatcgaggggcaccaggacgccgtcacggccgcgctgctcatccccaaggaggacggcgtgatcacggccagcgaggacagaaccatccgggtatggctgaaaagagacagtggtcaatactggcccagcatttaccacacaatggcctctccttgctctgctatggcttaccatcatgacagcagacggatatttgtgggccaggataatggagctgtaatggaatttcacgtttctgaagattttaataaaatgaactttatcaagacctacccagctcatcagaaccgggtgtctgcgattatcttcagcttggccacagagtgggtgatcagtaccggccacgacaagtgtgtgagctggatgtgcacgcggagcgggaacatgctcgggaggcacttcttcacgtcctgggcttcgtgtctgcaatatgactttgacactcagtatgctttcgttggtgattattctgggcagatcaccctgctgaagcttgaacagaacacgtgttcagtcatcacaaccctcaaaggacatgaaggtagtgtcgcctgcctctggtgggaccctattcagcggttactcttctcaggagcatctgacaacagcatcatcatgtgggacatcggaggaaggaaaggccggacgctgttacttcagggccatcatgacaaggtgcagtcgctgtgctaccttcagctcaccaggcagctcgtctcctgttcctcggacggcggaattgcagtgtggaacatggatgttagcagagaagaggctcctcagtggttggaaagtgattcttgtcagaaatgtgagcagccatttttctggaacataaagcagatgtgggacaccaagacgctggggctaagacaacatcactgcaggaaatgcgggcaggctgtctgcgggaagtgcagcagcaagcgctcaagttacccagtcatgggcttcgagttccaagtccgggtttgtgattcttgttacgactccatcaaagatgaagatcggacttctctagcgacctttcatgaaggaaaacataacatttcccacatgtccatggacattgccaggggactgatggtgacctgtgggaccgaccgcattgtaaagatctgggacatgacacctgtggtgggctgcagtctggcgactgggttttctccgcactgatctgagagctgggcggcgtccacacctaagaacagcagctccaccaaatgaagtccctctcacgcagctccacagcgctgtctcgtgaatggacagtagccacttacaaacaaatcaacatttttaaaaagaaaatgtaaaggtgtgttttggggcatttgtggaacttacccatggggactaatatggaaaaggtctgtccatagtggttccctgaagactggaattacttcagcaaaacttccccatgaacagctaatgtgtagtgaaagaatgagctagcaaatgagttttagcggggacaaaaaatcaaacaaaaaagtgaatgcttagaaccttctcaaagcagtcacaagtacagacacttcacttagcctagggggccttccagggttcttgtggctgttgtcagagcaggagctgggggagggaagacttgttctctctttcttgaggggtggcattaggaacttacgaaaccagagacctttccctatgacttggcagtatgtgaatatcctctacacttagttattgataaacttcttaaagagatctgttattttcaggtagtgccataatctgcacttagcattggcttgcttcagttgtttctcttcccagccagtatgccacaggtgaactttcgaggttgtcattaagtaagttgtgaaatttctgtaataacaaaggcagtccgcattcttccctttcccccaaattcctagggcaaaacttttttatggtgctgttaacatgggagtcacacaagccgcctgactttttctcattgccattagtaatgactgatggaaaacccagccaccactgtgatgcgaaatgatcagtctgttgcctgaaacagcccagtcctcttaactgaaacagcattctacttcttgttccaagatgagcctctgcaatattctggcaatttaatataccccctacaaaagcactccacagcttttacactattttgactttgagttataactagtattattcatgttttcataaaaagaagttagtgacccagagctataatcatccatcaagtcttccacaataattcccaactcataaattgctttcctaacaactagcaaaagctattgttcataatggcatttctaaagcttttgggcactgtgtaccaggatgaggaagagaagaaatgaggagcctgtcttttaatattccagtatttgtgtgtttgattttttttgacaacagtacatatatctatttctctagggatatggaagtaagtggagaagggcctacctttttaaaggacaaatataaaaatagcaacagtatctttgctaatcttactaatggatattgattaaaaaaaaaaaacctcagtactgcatcactgtgttgggatcgtaccaggacaatagggtcattccatatgataaaactaaaggactaaatttgttttataatgatgtcttagagggactgaaaagtttaaggaggcgatcaaactaaaatgtcttaatggctgtgtgacacacgtaaggaaaggaaagggggtcacgcacatcatgtactggaatgatctgcattaaacattgacttgtcttcagaaataagactgaagggttttgttgttccttagagttttcgtgttacatcacctaaagagatttcttttaaaaactttctagactctttgcaaaatgtatattactaacatagtttggaagaaaaattgagtagtggtaagttttgttcaagcacaatgttgaatgttaagcttcctgtattaattttagttcagttaatggttcagcccatacaaaggtgctatcctagggattttatgaattcctgaaaggaaaatagaatatgatcaattccttgccctgtggaagagtgcagaactgtggttttgttttcctttgacttctgtaaaatgtgaccgtttgacatctgtggtagattgaacggaatatcacagctgctgagtttactccatagctttcaaaccttttttattttaagaaattcttgaaaaaccctatgttccatgggaacataaagttattatagtgcctcctaaggggttaatataaatcaaggaggaagtttatatttaaggaagaattggagtgacgtatcttagaaaaggaaaggctgatgtttccatatagcttgctctccaccaggcctatcatttttctttttagagacaaacgtgacaggctagtcttgtctctctcatatgctaggtagcaaatggggtgatatttttatagaagtgggcaaaaattattttctcaattttactgagtaggcacagaagaaaagtacagataggctgatggttattgccttattttgactgcatttctcttaaatggatcatttaaattagttcttcaagtaacagtttactggttgttccattcctgaatatgcaggctaatttgtacagatagggattaaggaatacagactattagagaagatccttatatttacatctagtatatatgtggtaaggaaatgccgattcttcattataaacaagttttaaaattgttctttcttagttcaaatgatagcaatacccctatagcattaggtagaaacaaattattcattacatcgtaaatctctttactatgtcctagctctgtcctgctacctaaaggatataaagaaatattattgctctagaatgtattactttgttctcccatgaaagaattcagtttgttagtacctatatttttaaactggtgaaactgacccaaatatgtaataaataccatagtagctcagacccaaggagatatttttctaaaatcagttttcgttaaagtacttctacttccgttattggatatggtatctcctaaagtgtaaaaaaaatctgttactatatagtgataaaccatctgctcatcgtaagtgtaaggcttaacaaataagtaatacatgctatatttattcaagtgtctattgcttaattgttaattgtgagcagatttattgaatgcctattctattttctgcagtttacaatacaataactctttgagtaagttgaagtttaattgtgcaacaaatttgtattagagtacaatttaaagtgtttttctctatagccttttttgactggggaagcaaggggtaatgttaattagtacactttgttcttgtactagctatgtttctataagatatggtgccctgtgtatcccagagatgctagaaaactgttctttgctcctatttgtgggttctgtttttgtgggtttttttttttttgagaaaatgtacacaataaaacattccttgcttgtta

SEQ ID NO: 355288 - DNA, 4557 bp, Homo sapiens
gtcagctgatgggctgcctgccgaggaggccgcagcagtcgccgcgcgaacatggcggccgaaatccactccaggccgcagagcagccgcccggtgctgctgagcaagatcgaggggcaccaggacgccgtcacggccgcgctgctcatccccaaggaggacggcgtgatcacggccagcgaggacagaaccatccgggtatggctgaaaagagacagtggtcaatactggcccagcatttaccacacaatggcctctccttgctctgctatggcttaccatcatgacagcagacggatatttgtgggccaggataatggagctgtaatggtaggtagcttttagaatgtatttatattatcttcagcttggccacagagtgggtgatcagtaccggccacgacaagtgtgtgagctggatgtgcacgcggagcgggaacatgctcgggaggcacttcttcacgtcctgggcttcgtgtctgcaatatgactttgacactcagtatgctttcgttggtgattattctgggcagatcaccctgctgaagcttgaacagaacacgtgttcagtcatcacaaccctcaaaggacatgaaggtagtgtcgcctgcctctggtgggaccctattcagcggttactcttctcaggagcatctgacaacagcatcatcatgtgggacatcggaggaaggaaaggccggacgctgttacttcagggccatcatgacaaggtgcagtcgctgtgctaccttcagctcaccaggcagctcgtctcctgttcctcggacggcggaattgcagtgtggaacatggatgttagcagagaagaggctcctcagtggttggaaagtgattcttgtcagaaatgtgagcagccatttttctggaacataaagcagatgtgggacaccaagacgctggggctaagacaacatcactgcaggaaatgcgggcaggctgtctgcgggaagtgcagcagcaagcgctcaagttacccagtcatgggcttcgagttccaagtccgggtttgtgattcttgttacgactccatcaaagatgaagatcggacttctctagcgacctttcatgaaggaaaacataacatttcccacatgtccatggacattgccaggggactgatggtgacctgtgggaccgaccgcattgtaaagatctgggacatgacacctgtggtgggctgcagtctggcgactgggttttctccgcactgatctgagagctgggcggcgtccacacctaagaacagcagctccaccaaatgaagtccctctcacgcagctccacagcgctgtctcgtgaatggacagtagccacttacaaacaaatcaacatttttaaaaagaaaatgtaaaggtgtgttttggggcatttgtggaacttacccatggggactaatatggaaaaggtctgtccatagtggttccctgaagactggaattacttcagcaaaacttccccatgaacagctaatgtgtagtgaaagaatgagctagcaaatgagttttagcggggacaaaaaatcaaacaaaaaagtgaatgcttagaaccttctcaaagcagtcacaagtacagacacttcacttagcctagggggccttccagggttcttgtggctgttgtcagagcaggagctgggggagggaagacttgttctctctttcttgaggggtggcattaggaacttacgaaaccagagacctttccctatgacttggcagtatgtgaatatcctctacacttagttattgataaacttcttaaagagatctgttattttcaggtagtgccataatctgcacttagcattggcttgcttcagttgtttctcttcccagccagtatgccacaggtgaactttcgaggttgtcattaagtaagttgtgaaatttctgtaataacaaaggcagtccgcattcttccctttcccccaaattcctagggcaaaacttttttatggtgctgttaacatgggagtcacacaagccgcctgactttttctcattgccattagtaatgactgatggaaaacccagccaccactgtgatgcgaaatgatcagtctgttgcctgaaacagcccagtcctcttaactgaaacagcattctacttcttgttccaagatgagcctctgcaatattctggcaatttaatataccccctacaaaagcactccacagcttttacactattttgactttgagttataactagtattattcatgttttcataaaaagaagttagtgacccagagctataatcatccatcaagtcttccacaataattcccaactcataaattgctttcctaacaactagcaaaagctattgttcataatggcatttctaaagcttttgggcactgtgtaccaggatgaggaagagaagaaatgaggagcctgtcttttaatattccagtatttgtgtgtttgattttttttgacaacagtacatatatctatttctctagggatatggaagtaagtggagaagggcctacctttttaaaggacaaatataaaaatagcaacagtatctttgctaatcttactaatggatattgattaaaaaaaaaaaacctcagtactgcatcactgtgttgggatcgtaccaggacaatagggtcattccatatgataaaactaaaggactaaatttgttttataatgatgtcttagagggactgaaaagtttaaggaggcgatcaaactaaaatgtcttaatggctgtgtgacacacgtaaggaaaggaaagggggtcacgcacatcatgtactggaatgatctgcattaaacattgacttgtcttcagaaataagactgaagggttttgttgttccttagagttttcgtgttacatcacctaaagagatttcttttaaaaactttctagactctttgcaaaatgtatattactaacatagtttggaagaaaaattgagtagtggtaagttttgttcaagcacaatgttgaatgttaagcttcctgtattaattttagttcagttaatggttcagcccatacaaaggtgctatcctagggattttatgaattcctgaaaggaaaatagaatatgatcaattccttgccctgtggaagagtgcagaactgtggttttgttttcctttgacttctgtaaaatgtgaccgtttgacatctgtggtagattgaacggaatatcacagctgctgagtttactccatagctttcaaaccttttttattttaagaaattcttgaaaaaccctatgttccatgggaacataaagttattatagtgcctcctaaggggttaatataaatcaaggaggaagtttatatttaaggaagaattggagtgacgtatcttagaaaaggaaaggctgatgtttccatatagcttgctctccaccaggcctatcatttttctttttagagacaaacgtgacaggctagtcttgtctctctcatatgctaggtagcaaatggggtgatatttttatagaagtgggcaaaaattattttctcaattttactgagtaggcacagaagaaaagtacagataggctgatggttattgccttattttgactgcatttctcttaaatggatcatttaaattagttcttcaagtaacagtttactggttgttccattcctgaatatgcaggctaatttgtacagatagggattaaggaatacagactattagagaagatccttatatttacatctagtatatatgtggtaaggaaatgccgattcttcattataaacaagttttaaaattgttctttcttagttcaaatgatagcaatacccctatagcattaggtagaaacaaattattcattacatcgtaaatctctttactatgtcctagctctgtcctgctacctaaaggatataaagaaatattattgctctagaatgtattactttgttctcccatgaaagaattcagtttgttagtacctatatttttaaactggtgaaactgacccaaatatgtaataaataccatagtagctcagacccaaggagatatttttctaaaatcagttttcgttaaagtacttctacttccgttattggatatggtatctcctaaagtgtaaaaaaaatctgttactatatagtgataaaccatctgctcatcgtaagtgtaaggcttaacaaataagtaatacatgctatatttattcaagtgtctattgcttaattgttaattgtgagcagatttattgaatgcctattctattttctgcagtttacaatacaataactctttgagtaagttgaagtttaattgtgcaacaaatttgtattagagtacaatttaaagtgtttttctctatagccttttttgactggggaagcaaggggtaatgttaattagtacactttgttcttgtactagctatgtttctataagatatggtgccctgtgtatcccagagatgctagaaaactgttctttgctcctatttgtgggttctgtttttgtgggtttttttttttttgagaaaatgtacacaataaaacattccttgcttgtta

SEQ ID NO: 355289 - DNA, 2781 bp, Homo sapiens
ggtaccctcgtcttttgataggcaggtagtgccataatctgcacttagcattggcttgcttcagttgtttctcttcccagccagtatgccacaggtgaactttcgaggttgtcattaagtaagttgtgaaatttctgtaataacaaaggcagtccgcattcttccctttcccccaaattcctagggcaaaacttttttatggtgctgttaacatgggagtcacacaagccgcctgactttttctcattgccattagtaatgactgatggaaaacccagccaccactgtgatgcgaaatgatcagtctgttgcctgaaacagcccagtcctcttaactgaaacagcattctacttcttgttccaagatgagcctctgcaatattctggcaatttaatataccccctacaaaagcactccacagcttttacactattttgactttgagttataactagtattattcatgttttcataaaaagaagttagtgacccagagctataatcatccatcaagtcttccacaataattcccaactcataaattgctttcctaacaactagcaaaagctattgttcataatggcatttctaaagcttttgggcactgtgtaccaggatgaggaagagaagaaatgaggagcctgtcttttaatattccagtatttgtgtgtttgattttttttgacaacagtacatatatctatttctctagggatatggaagtaagtggagaagggcctacctttttaaaggacaaatataaaaatagcaacagtatctttgctaatcttactaatggatattgattaaaaaaaaaaaacctcagtactgcatcactgtgttgggatcgtaccaggacaatagggtcattccatatgataaaactaaaggactaaatttgttttataatgatgtcttagagggactgaaaagtttaaggaggcgatcaaactaaaatgtcttaatggctgtgtgacacacgtaaggaaaggaaagggggtcacgcacatcatgtactggaatgatctgcattaaacattgacttgtcttcagaaataagactgaagggttttgttgttccttagagttttcgtgttacatcacctaaagagatttcttttaaaaactttctagactctttgcaaaatgtatattactaacatagtttggaagaaaaattgagtagtggtaagttttgttcaagcacaatgttgaatgttaagcttcctgtattaattttagttcagttaatggttcagcccatacaaaggtgctatcctagggattttatgaattcctgaaaggaaaatagaatatgatcaattccttgccctgtggaagagtgcagaactgtggttttgttttcctttgacttctgtaaaatgtgaccgtttgacatctgtggtagattgaacggaatatcacagctgctgagtttactccatagctttcaaaccttttttattttaagaaattcttgaaaaaccctatgttccatgggaacataaagttattatagtgcctcctaaggggttaatataaatcaaggaggaagtttatatttaaggaagaattggagtgacgtatcttagaaaaggaaaggctgatgtttccatatagcttgctctccaccaggcctatcatttttctttttagagacaaacgtgacaggctagtcttgtctctctcatatgctaggtagcaaatggggtgatatttttatagaagtgggcaaaaattattttctcaattttactgagtaggcacagaagaaaagtacagataggctgatggttattgccttattttgactgcatttctcttaaatggatcatttaaattagttcttcaagtaacagtttactggttgttccattcctgaatatgcaggctaatttgtacagatagggattaaggaatacagactattagagaagatccttatatttacatctagtatatatgtggtaaggaaatgccgattcttcattataaacaagttttaaaattgttctttcttagttcaaatgatagcaatacccctatagcattaggtagaaacaaattattcattacatcgtaaatctctttactatgtcctagctctgtcctgctacctaaaggatataaagaaatattattgctctagaatgtattactttgttctcccatgaaagaattcagtttgttagtacctatatttttaaactggtgaaactgacccaaatatgtaataaataccatagtagctcagacccaaggagatatttttctaaaatcagttttcgttaaagtacttctacttccgttattggatatggtatctcctaaagtgtaaaaaaaatctgttactatatagtgataaaccatctgctcatcgtaagtgtaaggcttaacaaataagtaatacatgctatatttattcaagtgtctattgcttaattgttaattgtgagcagatttattgaatgcctattctattttctgcagtttacaatacaataactctttgagtaagttgaagtttaattgtgcaacaaatttgtattagagtacaatttaaagtgtttttctctatagccttttttgactggggaagcaaggggtaatgttaattagtacactttgttcttgtactagctatgtttctataagatatggtgccctgtgtatcccagagatgctagaaaactgttctttgctcctatttgtgggttctgtttttgtgggtttttttttttttgagaaaatgtacacaataaaacattccttgcttgtta

SEQ ID NO: 355290 - DNA, 1661 bp, Homo sapiens
gtcagctgatgggctgcctgccgaggaggccgcagcagtcgccgcgcgaacatggcggccgaaatccactccaggccgcagagcagccgcccggtgctgctgagcaagatcgaggggcaccaggacgccgtcacggccgcgctgctcatccccaaggaggacggcgtgatcacggccagcgaggacagaaccatccgggtatggctgaaaagagacagtggtcaatactggcccagcatttaccacacaatggcctctccttgctctgctatggcttaccatcatgacagcagacggatatttgtgggccaggataatggagctgtaatggaatttcacgtttctgaagattttaataaaatgaactttatcaagacctacccagctcatcagaaccgggtgtctgcgattatcttcagcttggccacagagtgggtgatcagtaccggccacgacaagtgtgtgagctggatgtgcacgcggagcgggaacatgctcgggaggcacttcttcacgtcctgggcttcgtgtctgcaatatgactttgacactcagtatgctttcgttggtgattattctgggcagatcaccctgctgaagcttgaacagaacacgtgttcagtcatcacaaccctcaaaggacatgaaggtagtgtcgcctgcctctggtgggaccctattcagcggttactcttctcaggagcatctgacaacagcatcatcatgtgggacatcggaggaaggaaaggccggacgctgttacttcagggccatcatgacaaggtgcagtcgctgtgctaccttcagctcaccaggcagctcgtctcctgttcctcggacggcggaattgcagtgtggaacatggatgttagcagagaagaggctcctcagtggttggaaagtgattcttgtcagaaatgtgagcagccatttttctggaacataaagcagatgtgggacaccaagacgctggggctaagacaacatcactgcaggaaatgcgggcaggctgtctgcgggaagtgcagcagcaagcgctcaagttacccagtcatgggcttcgagttccaagtccgggtttgtgattcttgttacgactccatcaaagatgaagatcggacttctctagcgacctttcatgaaggaaaacataacatttcccacatgtccatggacattgccaggggactgatggtgacctgtgggaccgaccgcattgtaaagatctgggacatgacacctgtggtgggctgcagtctggcgactgggttttctccgcactgatctgagagctgggcggcgtccacacctaagaacagcagctccaccaaatgaagtccctctcacgcagctccacagcgctgtctcgtgaatggacagtagccacttacaaacaaatcaacatttttaaaaagaaaatgtaaagagatggggtcttgccaggtcttggccaggctggtcttgaactcccggactcaagcaactctcctgacttggcctcccaaagtgttggaattacaggcatgagccactgcagtagccctgattgttttaaatagaagaagatacatttcatattgctcttcagtcgacaagggaaattacggctacagaaatggtacatcactctccctgataaagagaggaagaagatcacccgg

SEQ ID NO: 355291 - DNA, 325 bp, Homo sapiens
gaggcacttcttcacgtcctgggcttcgtgtctgcagtatccttcagagccacggacctctccttcccctggcctctgcttctcagtgtttggttctgaatctcatcccaaatggctgagatctaaagactgaatgaaacctatttaagtttgtgcaaaagtaattgcatttttttttttaccatggaaagtaattgcaaaaattgcaattacttttgcaccaacctaatacatatttcactgaaaatccgagaacttccgtaagtttgctgtaaattgggtttattaaaaataatgaaatgaattgttctgtgctgggaggtgc

SEQ ID NO: 355292 - DNA, 285 bp, Homo sapiens
catggacattgccaggggactgatggtgacctgtgggaccgaccgcattgtaaaggtaagctggctaattgtctgtcagcatctcagttgagattgcctattaccatgctgtgaatgtgcaggagacagtcactctttctgactggcaagctttataagcaaatgattgccagtttaaaaccttgagtaacaaattgcttgcctctgagtttccatgcattcattggtggtcagtcccagtggcacctccctctgcagtgtctgtctggcagagtgagtctggca

SEQ ID NO: 355293 - DNA, 4467 bp, Homo sapiens
gtcagctgatgggctgcctgccgaggaggccgcagcagtcgccgcgcgaacatggcggccgaaatccactccaggccgcagagcagccgcccggtgctgctgagcaagatcgaggggcaccaggacgccgtcacggccgcgctgctcatccccaaggaggacggcgtgatcacggccagcgaggacaggaatttcacgtttctgaagattttaataaaatgaactttatcaagacctacccagctcatcagaaccgggtgtctgcgattatcttcagcttggccacagagtgggtgatcagtaccggccacgacaagtgtgtgagctggatgtgcacgcggagcgggaacatgctcgggaggcacttcttcacgtcctgggcttcgtgtctgcaatatgactttgacactcagtatgctttcgttggtgattattctgggcagatcaccctgctgaagcttgaacagaacacgtgttcagtcatcacaaccctcaaaggacatgaaggtagtgtcgcctgcctctggtgggaccctattcagcggttactcttctcaggagcatctgacaacagcatcatcatgtgggacatcggaggaaggaaaggccggacgctgttacttcagggccatcatgacaaggtgcagtcgctgtgctaccttcagctcaccaggcagctcgtctcctgttcctcggacggcggaattgcagtgtggaacatggatgttagcagagaagaggctcctcagtggttggaaagtgattcttgtcagaaatgtgagcagccatttttctggaacataaagcagatgtgggacaccaagacgctggggctaagacaacatcactgcaggaaatgcgggcaggctgtctgcgggaagtgcagcagcaagcgctcaagttacccagtcatgggcttcgagttccaagtccgggtttgtgattcttgttacgactccatcaaagatgaagatcggacttctctagcgacctttcatgaaggaaaacataacatttcccacatgtccatggacattgccaggggactgatggtgacctgtgggaccgaccgcattgtaaagatctgggacatgacacctgtggtgggctgcagtctggcgactgggttttctccgcactgatctgagagctgggcggcgtccacacctaagaacagcagctccaccaaatgaagtccctctcacgcagctccacagcgctgtctcgtgaatggacagtagccacttacaaacaaatcaacatttttaaaaagaaaatgtaaaggtgtgttttggggcatttgtggaacttacccatggggactaatatggaaaaggtctgtccatagtggttccctgaagactggaattacttcagcaaaacttccccatgaacagctaatgtgtagtgaaagaatgagctagcaaatgagttttagcggggacaaaaaatcaaacaaaaaagtgaatgcttagaaccttctcaaagcagtcacaagtacagacacttcacttagcctagggggccttccagggttcttgtggctgttgtcagagcaggagctgggggagggaagacttgttctctctttcttgaggggtggcattaggaacttacgaaaccagagacctttccctatgacttggcagtatgtgaatatcctctacacttagttattgataaacttcttaaagagatctgttattttcaggtagtgccataatctgcacttagcattggcttgcttcagttgtttctcttcccagccagtatgccacaggtgaactttcgaggttgtcattaagtaagttgtgaaatttctgtaataacaaaggcagtccgcattcttccctttcccccaaattcctagggcaaaacttttttatggtgctgttaacatgggagtcacacaagccgcctgactttttctcattgccattagtaatgactgatggaaaacccagccaccactgtgatgcgaaatgatcagtctgttgcctgaaacagcccagtcctcttaactgaaacagcattctacttcttgttccaagatgagcctctgcaatattctggcaatttaatataccccctacaaaagcactccacagcttttacactattttgactttgagttataactagtattattcatgttttcataaaaagaagttagtgacccagagctataatcatccatcaagtcttccacaataattcccaactcataaattgctttcctaacaactagcaaaagctattgttcataatggcatttctaaagcttttgggcactgtgtaccaggatgaggaagagaagaaatgaggagcctgtcttttaatattccagtatttgtgtgtttgattttttttgacaacagtacatatatctatttctctagggatatggaagtaagtggagaagggcctacctttttaaaggacaaatataaaaatagcaacagtatctttgctaatcttactaatggatattgattaaaaaaaaaaaacctcagtactgcatcactgtgttgggatcgtaccaggacaatagggtcattccatatgataaaactaaaggactaaatttgttttataatgatgtcttagagggactgaaaagtttaaggaggcgatcaaactaaaatgtcttaatggctgtgtgacacacgtaaggaaaggaaagggggtcacgcacatcatgtactggaatgatctgcattaaacattgacttgtcttcagaaataagactgaagggttttgttgttccttagagttttcgtgttacatcacctaaagagatttcttttaaaaactttctagactctttgcaaaatgtatattactaacatagtttggaagaaaaattgagtagtggtaagttttgttcaagcacaatgttgaatgttaagcttcctgtattaattttagttcagttaatggttcagcccatacaaaggtgctatcctagggattttatgaattcctgaaaggaaaatagaatatgatcaattccttgccctgtggaagagtgcagaactgtggttttgttttcctttgacttctgtaaaatgtgaccgtttgacatctgtggtagattgaacggaatatcacagctgctgagtttactccatagctttcaaaccttttttattttaagaaattcttgaaaaaccctatgttccatgggaacataaagttattatagtgcctcctaaggggttaatataaatcaaggaggaagtttatatttaaggaagaattggagtgacgtatcttagaaaaggaaaggctgatgtttccatatagcttgctctccaccaggcctatcatttttctttttagagacaaacgtgacaggctagtcttgtctctctcatatgctaggtagcaaatggggtgatatttttatagaagtgggcaaaaattattttctcaattttactgagtaggcacagaagaaaagtacagataggctgatggttattgccttattttgactgcatttctcttaaatggatcatttaaattagttcttcaagtaacagtttactggttgttccattcctgaatatgcaggctaatttgtacagatagggattaaggaatacagactattagagaagatccttatatttacatctagtatatatgtggtaaggaaatgccgattcttcattataaacaagttttaaaattgttctttcttagttcaaatgatagcaatacccctatagcattaggtagaaacaaattattcattacatcgtaaatctctttactatgtcctagctctgtcctgctacctaaaggatataaagaaatattattgctctagaatgtattactttgttctcccatgaaagaattcagtttgttagtacctatatttttaaactggtgaaactgacccaaatatgtaataaataccatagtagctcagacccaaggagatatttttctaaaatcagttttcgttaaagtacttctacttccgttattggatatggtatctcctaaagtgtaaaaaaaatctgttactatatagtgataaaccatctgctcatcgtaagtgtaaggcttaacaaataagtaatacatgctatatttattcaagtgtctattgcttaattgttaattgtgagcagatttattgaatgcctattctattttctgcagtttacaatacaataactctttgagtaagttgaagtttaattgtgcaacaaatttgtattagagtacaatttaaagtgtttttctctatagccttttttgactggggaagcaaggggtaatgttaattagtacactttgttcttgtactagctatgtttctataagatatggtgccctgtgtatcccagagatgctagaaaactgttctttgctcctatttgtgggttctgtttttgtgggtttttttttttttgagaaaatgtacacaataaaacattccttgcttgtta

SEQ ID NO: 355294 - DNA, 3348 bp, Homo sapiens
gtcagctgatgggctgcctgccgaggaggccgcagcagtcgccgcgcgaacatggcggccgaaatccactccaggccgcagagcagccgcccggtgctgctgagcaagatcgaggggcaccaggacgccgtcacggccgcgctgctcatccccaaggaggacggcgtgatcacggccagcgaggacagaaccatccgggtatggctgaaaagagacagtggtcaatactggcccagcatttaccacacaatggcctctccttgctctgctatggcttaccatcatgacagcagacggatatttgtgggccaggataatggagctgtaatggaatttcacgtttctgaagattttaataaaatgaactttatcaagacctacccagctcatcagaaccgggtgtctgcgattatcttcagcttggccacagagtgggtgatcagtaccggccacgacaagtgtgtgagctggatgtgcacgcggagcgggaacatgctcgggaggcacttcttcacgtcctgggcttcgtgtctgcaatatgactttgacactcagtatgctttcgttggtgattattctgggcagatcaccctgctgaagcttgaacagaacacgtgttcagtcatcacaaccctcaaaggacatgaaggtagtgtcgcctgcctctggtgggaccctattcagcggttactcttctcaggagcatctgacaacagcatcatcatgtgggacatcggaggaaggaaaggccggacgctgttacttcagggccatcatgacaaggtgcagtcgctgtgctaccttcagctcaccaggcagctcgtctcctgttcctcggacggcggaattgcagtgtggaacatggatgttagcagagaagaggctcctcagtggttggaaagtgattcttgtcagaaatgtgagcagccaagatgagcctctgcaatattctggcaatttaatataccccctacaaaagcactccacagcttttacactattttgactttgagttataactagtattattcatgttttcataaaaagaagttagtgacccagagctataatcatccatcaagtcttccacaataattcccaactcataaattgctttcctaacaactagcaaaagctattgttcataatggcatttctaaagcttttgggcactgtgtaccaggatgaggaagagaagaaatgaggagcctgtcttttaatattccagtatttgtgtgtttgattttttttgacaacagtacatatatctatttctctagggatatggaagtaagtggagaagggcctacctttttaaaggacaaatataaaaatagcaacagtatctttgctaatcttactaatggatattgattaaaaaaaaaaaacctcagtactgcatcactgtgttgggatcgtaccaggacaatagggtcattccatatgataaaactaaaggactaaatttgttttataatgatgtcttagagggactgaaaagtttaaggaggcgatcaaactaaaatgtcttaatggctgtgtgacacacgtaaggaaaggaaagggggtcacgcacatcatgtactggaatgatctgcattaaacattgacttgtcttcagaaataagactgaagggttttgttgttccttagagttttcgtgttacatcacctaaagagatttcttttaaaaactttctagactctttgcaaaatgtatattactaacatagtttggaagaaaaattgagtagtggtaagttttgttcaagcacaatgttgaatgttaagcttcctgtattaattttagttcagttaatggttcagcccatacaaaggtgctatcctagggattttatgaattcctgaaaggaaaatagaatatgatcaattccttgccctgtggaagagtgcagaactgtggttttgttttcctttgacttctgtaaaatgtgaccgtttgacatctgtggtagattgaacggaatatcacagctgctgagtttactccatagctttcaaaccttttttattttaagaaattcttgaaaaaccctatgttccatgggaacataaagttattatagtgcctcctaaggggttaatataaatcaaggaggaagtttatatttaaggaagaattggagtgacgtatcttagaaaaggaaaggctgatgtttccatatagcttgctctccaccaggcctatcatttttctttttagagacaaacgtgacaggctagtcttgtctctctcatatgctaggtagcaaatggggtgatatttttatagaagtgggcaaaaattattttctcaattttactgagtaggcacagaagaaaagtacagataggctgatggttattgccttattttgactgcatttctcttaaatggatcatttaaattagttcttcaagtaacagtttactggttgttccattcctgaatatgcaggctaatttgtacagatagggattaaggaatacagactattagagaagatccttatatttacatctagtatatatgtggtaaggaaatgccgattcttcattataaacaagttttaaaattgttctttcttagttcaaatgatagcaatacccctatagcattaggtagaaacaaattattcattacatcgtaaatctctttactatgtcctagctctgtcctgctacctaaaggatataaagaaatattattgctctagaatgtattactttgttctcccatgaaagaattcagtttgttagtacctatatttttaaactggtgaaactgacccaaatatgtaataaataccatagtagctcagacccaaggagatatttttctaaaatcagttttcgttaaagtacttctacttccgttattggatatggtatctcctaaagtgtaaaaaaaatctgttactatatagtgataaaccatctgctcatcgtaagtgtaaggcttaacaaataagtaatacatgctatatttattcaagtgtctattgcttaattgttaattgtgagcagatttattgaatgcctattctattttctgcagtttacaatacaataactctttgagtaagttgaagtttaattgtgcaacaaatttgtattagagtacaatttaaagtgtttttctctatagccttttttgactggggaagcaaggggtaatgttaattagtacactttgttcttgtactagctatgtttctataagatatggtgccctgtgtatcccagagatgctagaaaactgttctttgctcctatttgtgggttctgtttttgtgggtttttttttttttgagaaaatgtacacaataaaacattccttgcttgtta

SEQ ID NO: 355295 - DNA, 1633 bp, Homo sapiens
gtcagctgatgggctgcctgccgaggaggccgcagcagtcgccgcgcgaacatggcggccgaaatccactccaggccgcagagcagccgcccggtgctgctgagcaagatcgaggggcaccaggacgccgtcacggccgcgctgctcatccccaaggaggacggcgtgatcacggccagcgaggacagaaccatccgggtatggctgaaaagagacagtggtcaatactggcccagcatttaccacacaatggcctctccttgctctgctatggcttaccatcatgacagcagacggatatttgtgggccaggataatggagctgtaatggaatttcacgtttctgaagattttaataaaatgaactttatcaagacctacccagctcatcagaaccgggtgtctgcgattatcttcagcttggccacagagtgggtgatcagtaccggccacgacaagtgtgtgagctggatgtgcacgcggagcgggaacatgctcgggaggcacttcttcacgtcctgggcttcgtgtctgcaatatgactttgacactcagtatgctttcgttggtgattattctgggcagatcaccctgctgaagcttgaacagaacacgtgttcagtcatcacaaccctcaaaggacatgaaggtagtgtcgcctgcctctggtgggaccctattcagcggttactcttctcaggagcatctgacaacagcatcatcatgtgggacatcggaggaaggaaaggccggacgctgttacttcagggccatcatgacaaggtgcagtcgctgtgctaccttcagctcaccaggcagctcgtctcctgttcctcggacggcggaattgcagtgtggaacatggatgttagcagagaagaggctcctcagtggttggaaagtgattcttgtcagaaatgtgagcagccatttttctggaacataaagcagatgtgggacaccaagacgctggggctaagacaacatcactgcaggaaatgcgggcaggctgtctgcgggaagtgcagcagcaagcgctcaagttacccagtcatgggcttcgagttccaagtccgggtttgtgattcttgttacgactccatcaaagatgaagatcggacttctctagcgacctttcatgaaggaaaacataacatttcccacatgtccatggacattgccaggggactgatggtgacctgtgggaccgaccgcattgtaaagatctgggacatgacacctgtggtgggctgcagtctggcgactgggttttctccgcactgatctgagagctgggcggcgtccacacctaagaacagcagctccaccaaatgaagtccctctcacgcagctccacagcgctgtctcgtgaatggacagtagccacttacaaacaaatcaacatttttaaaaagaaaatgtaaagagatggggtcttgccaggtcttggccaggctggtcttgaactcccggactcaagcaactctcctgacttggcctcccaaagtgttggaattacaggcatgagccactgcagtagccctgattgttttaaatagaagaaggtaaagtattttctcacataaatttctgaatgtgggaggcagcctactgacattgcttcacgtaacaa

SEQ ID NO: 355296 - DNA, 1350 bp, Homo sapiens
cctcctgaagtgctgagattacacgcgtgagccaccacgcccatcctcggatagtctcaatttgatcctaggataataccaggtcatcagagagctgttgatttggaccatattatgatttgaacctcccagatcattctcggcaccatgtctacaagccacatttagaggacaataggatacagcttggtgaaacacacagcggcatctctcataagacactggtgaggccacagatcccaccatcagtgtcacccgcctggggacatttcactttcagaaaatgcagagcttctcctaagaaatgaatgtggccaggtgtgttggctcacacctgtcatcccagcactttgggaggccaaggcgagcacattgcctgaggtcaggagttcaagaccagcctgaccaacatggtgaaacccagtcactactaaaaatacaaaaattcgccaggcgtggtagtgtgtgcctgtagtcccagccactcaggaggttgaggcaggagaatcgcttgaacccgggaggaggaggttgcggtgagctgagatcacgccactgcactccagcctgggcgacagagcgagacttcgtctcaaaaaacaaacaaaaaaagaaatgaatgttttaggcacacgctaagtatctcttagacgattccaaagatatcaattactgtgactgacgacgactcttccccttccctgggtgtgcctgtcctgcttccctagctcacaggtgctcaggactcaaaggcagcccgccacaggccatgggatctggctggctcaaaagggagagtgaggccattggaattttcccaggagtgagtctgaagcttggaatgttttttggtggagggtcctgaagctaggaggcgatgcagacgtgggggctgagacattatttggggccatttgcaaagagggatactcaggcagtgaccccaaggaaagagcaaggggaggagagggcggcacatccacgccccttcaactcctgcccgtccggaggcctacgcactccacacgccggcctccccgcatggatatccttccaataagcaactcatcgtgctcatgtttatttattttaaagtcacacagaattgcacttattaaaaatgaatttatggagacagaaagcattctggtggctgccaagggctggagagggcgaatggggagtgagtccttcatggatacggggtttccctttggggtgatgaaaaagttctggcgctagacagtgctgatggttgcacgacactgtgaatgtactcagtgttactaatggcaaattttatgttctgtgcattttagcacaataaaaaaatatacatttaaagcaaca

SEQ ID NO: 355297 - DNA, 1384 bp, Homo sapiens
aggccctgaactatttaaggatccaggtgttgcaaggcggtaagttttgcagccagtgtccatgaggtcggggctgggactagattagggtagatctaagcctgggcttgggagtgcagctagcgcagaaagatctgaggaactagagcaaaaagccatgcggatggattgtggtcgtcagaggctcccgtagtctttagcggcgctggcttccgcaggctccgccctctcttgcccacccggaaacagcctcgccccgcctacgcgggacccaaccgcggcgaccggacgtgcactcctccagtagcggctgcacgtcgtgccaatggcccgctatgaggaggtgagcgtgtccggcttcgaggagttccaccgggccgtggaacagcacaatggcaagaccattttcgcctactttacgggttctaaggacgccggggggaaaagctggtgccccgactgcgtgcaggctgaaccagtcgtacgagaggggctgaagcacattagtgaaggatgtgtgttcatctactgccaagtaggagaaaagccttattggaaagatccaaataatgacttcagaaaaaacttgaaagtaacagcagtgcctacactacttaagtatggaacacctcaaaaactggtagaatctgagtgtcttcaggccaacctggtggaaatgttgttctctgaagattaagattttaggatggcaatcatgtcttgatgtcctgatttgttctagtatcaataaactgtatacttgctttgaattcatgttagcaataaatgatgttaaaaaaactggcatgtgtctaaacaatagagtgctattaaaatgcccatgaacctttagtttgcctgtaatacatggatatttttaagatataaagaagtcttcagaaatagcagtaaaggctcaaaggaacgtattcttgaaggtgacggaaatacctaaaaactcctaaaggtgcagagcacaccttccaaatctctcaaaagatcagtatcttttattttaagttatctccatctgcaaagcaactgatgatattcctgaaaccccttctttgattttggaatgtagaacctaacctcaccactgaaggaaagcacatgacctctaatctagcctctgcttaattcaggcagttttgttttgtttaataaaaaacagactcctgagcactagaagcagtttgttttgcagctgtctcaatgtgctttacttgggatgaggcaggtggcggagagcggccggaaagactctataacccagttgtgggaagaactccaagctgggagtcagtcacactgactctaccacttactagctgtgtaaccacaggcaagttactcaccccgtccaaacctcagttttctcttc

SEQ ID NO: 355298 - DNA, 1414 bp, Homo sapiens
aggccctgaactatttaaggatccaggtgttgcaaggcggtaagttttgcagccagtgtccatgaggtcggggctgggactagattagggtagatctaagcctgggcttgggagtgcagctagcgcagaaagatctgaggaactagagcaaaaagccatgcggatggattgtggtcgtcagaggctcccgtagtctttagcggcgctggcttccgcaggctccgccctctcttgcccacccggaaacagcctcgccccgcctacgcgggacccaaccgcggcgaccggacgtgcactcctccagtagcggctgcacgtcgtgccaatggcccgctatgaggaggtgagcgtgtccggcttcgaggagttccaccgggccgtggaacagcacaatggcaagaccattttcgcctactttacgggttctaaggacgccggggggaaaagctggtgccccgactgcgtgcaggctgaaccagtcgtacgagaggggctgaagcacattagtgaaggatgtgtgttcatctactgccaagtaggagaaaagccttattggaaagatccaaataatgacttcagaaaaaacttgaaagtaacagcagtgcctacactacttaagtatggaacacctcaaaaactggtagaatctgagtgtcttcaggccaacctggtggaaatgttgttctctgaagattaagattttaggatggcaatcatgtcttgatgtcctgatttgttctagtatcaataaactgtatacttgctttgaattcatgttagcaataaatgatgttaaaaaaaaacaaaaaaacaaaaaaaagacacaaacaaaaaaaaaacaaaaaaaaaaaacaacaaaacaaaacaacagcacacaaaaaagcaacaacagacaaaaccaacaacaaggaaaggagagggaggtggcaggcacatcaatgctaaatcacctagctgtggaagacgagcactgacacagcgaactgtcacaccgaatgttatattatgaaagaacgagatgatccacataaggacggcgttctatacacataccaacgaggcagacgtctcacgcgctttttttacatacaccgcgtgttaggtaggaggagaaaaacgggcaaggcgtcgtttgggatcagactttatgatagaggagcccaccactaactcgttgtgtgttggggagaattacaccacaacttgctggggcgacctccacaactctcgaatggaggagaaatagataacacagcccgaagcggccggtaaaataatagacaaataaaaaaggaagtaggacgtggagcggtggaaaacaacaacaagcagaaattaatacgttctgtctgagcagaacaaataaatttcgactaccagactaagaagatagaagaagcaaatatctacacgg

SEQ ID NO: 355299 - DNA, 1909 bp, Homo sapiens
aggccctgaactatttaaggatccaggtgttgcaaggcggtaagttttgcagccagtgtccatgaggtcggggctgggactagattagggtagatctaagcctgggcttgggagtgcagctagcgcagaaagatctgaggaactagagcaaaaagccatgcggatggattgtggtcgtcagaggctcccgtagtctttagcggcgctggcttccgcaggctccgccctctcttgcccacccggaaacagcctcgccccgcctacgcgggacccaaccgcggcgaccggacgtgcactcctccagtagcggctgcacgtcgtgccaatggcccgctatgaggaggtgagcgtgtccggcttcgaggagttccaccgggccgtggaacagcacaatggcaagaccattttcgcctactttacgggttctaaggacgccggggggaaaagctggtgccccgactgcgtgcagggtgaggccgggattcgggggctgctgtccaatggaaatggcaggaaggtcgagcctacggccagaaggggggcttagcggaggcagagtcttggttccagacatccgcggagcaatctgagctgtccccaagtctccttctattaaatcctaccccgccctgccaagagcgctcttccttttaccaccttacccggatgatcttggaatctagttccttaaaacttctcactcccccagtaccattagtgtcttacaggatacgtgagttggtcagcaaatacatgtgctttccattgttacgggcgcggtggtgcaggggcaaatcgggactgggatttggtccttacccttaacgtggctctaagaccagaagggaacacctgacttctgttgacctcttcagttagctgcaggttaaagtctgagtgcttaccaagactgggggaagggggaaagaacacagtttatacgtgcctgattgtagagttgacgtgcgattattttatctcaactttttttaaagctgaaccagtcgtacgagaggggctgaagcacattagtgaaggatgtgtgttcatctactgccaagtaggagaaaagccttattggaaagatccaaataatgacttcagaaaaaacttgaaagtaacagcagtgcctacactacttaagtatggaacacctcaaaaactggtagaatctgagtgtcttcaggccaacctggtggaaatgttgttctctgaagattaagattttaggatggcaatcatgtcttgatgtcctgatttgttctagtatcaataaactgtatacttgctttgaattcatgttagcaataaatgatgttaaaaaaactggcatgtgtctaaacaatagagtgctattaaaatgcccatgaacctttagtttgcctgtaatacatggatatttttaagatataaagaagtcttcagaaatagcagtaaaggctcaaaggaacgtattcttgaaggtgacggaaatacctaaaaactcctaaaggtgcagagcacaccttccaaatctctcaaaagatcagtatcttttattttaagttatctccatctgcaaagcaactgatgatattcctgaaaccccttctttgattttggaatgtagaacctaacctcaccactgaaggaaagcacatgacctctaatctagcctctgcttaattcaggcagttttgttttgtttaataaaaaacagactcctgagcactagaagcagtttgttttgcagctgtctcaatgtgctttacttgggatgaggcaggtggcggagagcggccggaaagactctataacccagttgtgggaagaactccaagctgggagtcagtcacactgactctaccacttactagctgtgtaaccacaggcaagttactcaccccgtccaaacctcagttttctcttc

SEQ ID NO: 355300 - DNA, 1309 bp, Homo sapiens
aggccctgaactatttaaggatccaggtgttgcaaggcggtaagttttgcagccagtgtccatgaggtcggggctgggactagattagggtagatctaagcctgggcttgggagtgcagctagcgcagaaagatctgaggaactagagcaaaaagccatgcggatggattgtggtcgtcagaggctcccgtagtctttagcggcgctggcttccgcaggctccgccctctcttgcccacccggaaacagcctcgccccgcctacgcgggacccaaccgcggcgaccggacgtgcactcctccagtagcggctgcacgtcgtgccaatggcccgctatgaggaggtgagcgtgtccggcttcgaggagttccaccgggccgtggaacagcacaatgctgaaccagtcgtacgagaggggctgaagcacattagtgaaggatgtgtgttcatctactgccaagtaggagaaaagccttattggaaagatccaaataatgacttcagaaaaaacttgaaagtaacagcagtgcctacactacttaagtatggaacacctcaaaaactggtagaatctgagtgtcttcaggccaacctggtggaaatgttgttctctgaagattaagattttaggatggcaatcatgtcttgatgtcctgatttgttctagtatcaataaactgtatacttgctttgaattcatgttagcaataaatgatgttaaaaaaactggcatgtgtctaaacaatagagtgctattaaaatgcccatgaacctttagtttgcctgtaatacatggatatttttaagatataaagaagtcttcagaaatagcagtaaaggctcaaaggaacgtattcttgaaggtgacggaaatacctaaaaactcctaaaggtgcagagcacaccttccaaatctctcaaaagatcagtatcttttattttaagttatctccatctgcaaagcaactgatgatattcctgaaaccccttctttgattttggaatgtagaacctaacctcaccactgaaggaaagcacatgacctctaatctagcctctgcttaattcaggcagttttgttttgtttaataaaaaacagactcctgagcactagaagcagtttgttttgcagctgtctcaatgtgctttacttgggatgaggcaggtggcggagagcggccggaaagactctataacccagttgtgggaagaactccaagctgggagtcagtcacactgactctaccacttactagctgtgtaaccacaggcaagttactcaccccgtccaaacctcagttttctcttc

SEQ ID NO: 355301 - DNA, 821 bp, Homo sapiens
  misc_feature (769)..(769): n is a, c, g, or t
aggccctgaactatttaaggatccaggtgttgcaaggcggtaagttttgcagccagtgtccatgaggtcggggctgggactagattagggtagatctaagcctgggcttgggagtgcagctagcgcagaaagatctgaggaactagagcaaaaagccatgcggatggattgtggtcgtcagaggctcccgtagtctttagcggcgctggcttccgcaggctccgccctctcttgcccacccggaaacagcctcgccccgcctacgcgggacccaaccgcggcgaccggacgtgcactcctccagtagcggctgcacgtcgtgccaatggcccgctatgaggaggtgagcgtgtccggcttcgaggagttccaccgggccgtggaacagcacaatggcaagaccattttcgcctactttacgggttctaaggacgccggggggaaaagctggtgccccgactgcgtgcaggctgaaccagtcgtacgagaggggctgaagcacattagtgaaggatgtgtgttcatctactgccaagtaggagaaaagccttattggaaagatccaaataatgacttcagaaaaaacttgaaagtaacagcagtgcctacactacttaagtatggaacacctcaaaaactggtagaatctgagtgtcttcaggccaacctggtggaaatgttgttctctgaagattaagattttaggatggcaatcatgtcttgatgtcctgatttgttctagtatcaataaactgtatacttgcttttnacatcatttattgctaacatgaattcaaagcaaggtcgacgcggccgcgaat

SEQ ID NO: 355302 - DNA, 1257 bp, Homo sapiens
aggccctgaactatttaaggatccaggtgttgcaaggcggtaagttttgcagccagtgtccatgaggtcggggctgggactagattagggtagatctaagcctgggcttgggagtgcagctagcgcagaaagatctgaggaactagagcaaaaagccatgcggatggattgtggtcgtcagaggctcccgtagtctttagcggcgctggcttccgcaggctccgccctctcttgcccacccggaaacagcctcgccccgcctacgcgggacccaaccgcggcgaccggacgtgcactcctccagtagcggctgcacgtcgtgccaatggcccgctatgaggagctgaaccagtcgtacgagaggggctgaagcacattagtgaaggatgtgtgttcatctactgccaagtaggagaaaagccttattggaaagatccaaataatgacttcagaaaaaacttgaaagtaacagcagtgcctacactacttaagtatggaacacctcaaaaactggtagaatctgagtgtcttcaggccaacctggtggaaatgttgttctctgaagattaagattttaggatggcaatcatgtcttgatgtcctgatttgttctagtatcaataaactgtatacttgctttgaattcatgttagcaataaatgatgttaaaaaaactggcatgtgtctaaacaatagagtgctattaaaatgcccatgaacctttagtttgcctgtaatacatggatatttttaagatataaagaagtcttcagaaatagcagtaaaggctcaaaggaacgtattcttgaaggtgacggaaatacctaaaaactcctaaaggtgcagagcacaccttccaaatctctcaaaagatcagtatcttttattttaagttatctccatctgcaaagcaactgatgatattcctgaaaccccttctttgattttggaatgtagaacctaacctcaccactgaaggaaagcacatgacctctaatctagcctctgcttaattcaggcagttttgttttgtttaataaaaaacagactcctgagcactagaagcagtttgttttgcagctgtctcaatgtgctttacttgggatgaggcaggtggcggagagcggccggaaagactctataacccagttgtgggaagaactccaagctgggagtcagtcacactgactctaccacttactagctgtgtaaccacaggcaagttactcaccccgtccaaacctcagttttctcttc

SEQ ID NO: 355303 - DNA, 953 bp, Homo sapiens
aggccctgaactatttaaggatccaggtgttgcaaggcgctgaaccagtcgtacgagaggggctgaagcacattagtgaaggatgtgtgttcatctactgccaagtaggagaaaagccttattggaaagatccaaataatgacttcagaaaaaacttgaaagtaacagcagtgcctacactacttaagtatggaacacctcaaaaactggtagaatctgagtgtcttcaggccaacctggtggaaatgttgttctctgaagattaagattttaggatggcaatcatgtcttgatgtcctgatttgttctagtatcaataaactgtatacttgctttgaattcatgttagcaataaatgatgttaaaaaaactggcatgtgtctaaacaatagagtgctattaaaatgcccatgaacctttagtttgcctgtaatacatggatatttttaagatataaagaagtcttcagaaatagcagtaaaggctcaaaggaacgtattcttgaaggtgacggaaatacctaaaaactcctaaaggtgcagagcacaccttccaaatctctcaaaagatcagtatcttttattttaagttatctccatctgcaaagcaactgatgatattcctgaaaccccttctttgattttggaatgtagaacctaacctcaccactgaaggaaagcacatgacctctaatctagcctctgcttaattcaggcagttttgttttgtttaataaaaaacagactcctgagcactagaagcagtttgttttgcagctgtctcaatgtgctttacttgggatgaggcaggtggcggagagcggccggaaagactctataacccagttgtgggaagaactccaagctgggagtcagtcacactgactctaccacttactagctgtgtaaccacaggcaagttactcaccccgtccaaacctcagttttctcttc

SEQ ID NO: 355304 - DNA, 1308 bp, Homo sapiens
aggccctgaactatttaaggatccaggtgttgcaaggcggtaagttttgcagccagtgtccatgaggtcggggctgggactagattagggtagatctaagcctgggcttgggagtgcagctagcgcagaaagatctgaggaactagagcaaaaagccatgcggatggattgtggtcgtcagaggctcccgtagtctttagcggcgctggcttccgcaggctccgccctctcttgcccacccggaaacagcctcgccccgcctacgcgggacccaaccgcggcgaccggacgtgcactcctccagtagcggctgcacgtcgtgccaatggcccgctatgaggaggtgagcgtgtccggcttcgaggagttccaccgggccgtggaacagcacaatggcaagaccattttcgcctactttacgggttctaaggacgccggggggaaaagctggtgccccgactgcgtgcaggctgaaccagtcgtacgagaggggctgaagcacattagtgaaggatgtgtgttcatctactgccaagtaggagaaaagccttacctcaaaaactggtagaatctgagtgtcttcaggccaacctggtggaaatgttgttctctgaagattaagattttaggatggcaatcatgtcttgatgtcctgatttgttctagtatcaataaactgtatacttgctttgaattcatgttagcaataaatgatgttaaaaaaactggcatgtgtctaaacaatagagtgctattaaaatgcccatgaacctttagtttgcctgtaatacatggatatttttaagatataaagaagtcttcagaaatagcagtaaaggctcaaaggaacgtattcttgaaggtgacggaaatacctaaaaactcctaaaggtgcagagcacaccttccaaatctctcaaaagatcagtatcttttattttaagttatctccatctgcaaagcaactgatgatattcctgaaaccccttctttgattttggaatgtagaacctaacctcaccactgaaggaaagcacatgacctctaatctagcctctgcttaattcaggcagttttgttttgtttaataaaaaacagactcctgagcactagaagcagtttgttttgcagctgtctcaatgtgctttacttgggatgaggcaggtggcggagagcggccggaaagactctataacccagttgtgggaagaactccaagctgggagtcagtcacactgactctaccacttactagctgtgtaaccacaggcaagttactcaccccgtccaaacctcagttttctcttc

SEQ ID NO: 355305 - DNA, 661 bp, Homo sapiens
aggccctgaactatttaaggatccaggtgttgcaaggcggtaagttttgcagccagtgtccatgaggtcggggctgggactagattagggtagatctaagcctgggcttgggagtgcagctagcgcagaaagatctgaggaactagagcaaaaagccatgcggatggattgtggtcgtcagaggctcccgtagtctttagcggcgctggcttccgcaggctccgccctctcttgcccacccggaaacagcctcgccccgcctacgcgggacccaaccgcggcgaccggacgtgcactcctccagtagcggctgcacgtcgtgccaatggcccgctatgaggaggtgagcgtgtccggcttcgaggagttccaccgggccgtggaacagcacaatggcaagaccattttcgcctactttacgggttctaaggacgccggggggaaaagctggtgccccgactgcgtgcaggctgaaccagtcgtacgagaggggctgaagcacattagtgaaggatgtgtgttcatctactgccaagtaggagaaaagccttattggaaagatccaaataatgacttcagaaaaaacttgaaagtaacagcagtgcctacactacttaagtatggaacagtaagtatctttaaatatgctgggcctgtaatt

SEQ ID NO: 355306 - DNA, 1235 bp, Homo sapiens
aggccctgaactatttaaggatccaggtgttgcaaggcggtaagttttgcagccagtgtccatgaggtcggggctgggactagattagggtagatctaagcctgggcttgggagtgcagctagcgcagaaagatctgaggaactagagcaaaaagccatgcggatggattgtggtcgtcagaggctcccgtagtctttagcggcgctggcttccgcaggctccgccctctcttgcccacccggaaacagcctcgccccgcctacgcgggacccaaccgcggcgaccggacgtgcactcctccagtagcggctgcacgtcgtgccaatggcccgctatgaggaggtgagcgtgtccggcttcgaggagttccaccgggccgtggaacagcacaatggcaagaccattttcgcctactttacgggttctaaggacgccggggggaaaagctggtgccccgactgcgtgcaggctgaaccagtcgtacgagaggggctgaagcacattagtgaaggatgtgtgttcatctactgccaagtaggagaaaagccttattggaaagatccaaataatgacttcagaaaaaacttgaaagtaacagcagtgcctacactacttaagtatggaacacctcaaaaactggtagaatctgagtgtcttcaggccaacctggtggaaatgttgttctctgaagattaagattttaggatggcaatcatgtcttgatgtcctgatttgttctagtatcaataaactgtatacttgctttgaattcatgttagcaataaatgatgttaaaaagagaaaaaaaagatgcgagacttagggaaaaccgaattgggaggtgtcttcttaacagggcgcgggaaagaacggggagccagttgatgggaaacgggttgtggaaagggactttgggataacgatgaagaggaagagccccaggtccgtcaaagagcacgccagtccccctaagaaagagatcgggggatccgaacgttccgcaaccaaaggtctggctccccgcgacttctcgtggaagccggaccatctttggggccacccggggactggggtttgagcatcctcggaggtcagctcggattgcttccccaaggccacctggcgatggagtcctgtgacaggccattccgggagggcacaaaggggctcggggggccccaaagattgagccgcacaggactgtgaggctgcttggcacaaagggatgctccac

SEQ ID NO: 355307 - DNA, 1799 bp, Homo sapiens
aggccctgaactatttaaggatccaggtgttgcaaggcggtaagttttgcagccagtgtccatgaggtcggggctgggactagattagggtagatctaagcctgggcttgggagtgcagctagcgcagaaagatctgaggaactagagcaaaaagccatgcggatggattgtggtcgtcagaggctcccgtagtctttagcggcgctggcttccgcaggctccgccctctcttgcccacccggaaacagcctcgccccgcctacgcgggacccaaccgcggcgaccggacgtgcactcctccagtagcggctgcacgtcgtgccaatggcccgctatgaggaggtgagcgtgtccggcttcgaggagttccaccgggccgtggaacagcacaatggcaagaccattttcgcctactttacgggttctaaggacgccggggggaaaagctggtgccccgactgcgtgcagggtgaggccgggattcgggggctgctgtccaatggaaatggcaggaaggtcgagcctacggccagaaggggggcttagcggaggcagagtcttggttccagacatccgcggagcaatctgagctgtccccaagtctccttctattaaatcctaccccgccctgccaagagcgctcttccttttaccaccttacccggatgatcttggaatctagttccttaaaacttctcactcccccagtaccattagtgtcttacaggatacgtgagttggtcagcaaatacatgtgctttccattgttacgggcgcggtggtgcaggggcaaatcgggactgggatttggtccttacccttaacgtggctctaagaccagaagggaacacctgacttctgttgacctcttcagttagctgcagctgaaccagtcgtacgagaggggctgaagcacattagtgaaggatgtgtgttcatctactgccaagtaggagaaaagccttattggaaagatccaaataatgacttcagaaaaaacttgaaagtaacagcagtgcctacactacttaagtatggaacacctcaaaaactggtagaatctgagtgtcttcaggccaacctggtggaaatgttgttctctgaagattaagattttaggatggcaatcatgtcttgatgtcctgatttgttctagtatcaataaactgtatacttgctttgaattcatgttagcaataaatgatgttaaaaaaactggcatgtgtctaaacaatagagtgctattaaaatgcccatgaacctttagtttgcctgtaatacatggatatttttaagatataaagaagtcttcagaaatagcagtaaaggctcaaaggaacgtattcttgaaggtgacggaaatacctaaaaactcctaaaggtgcagagcacaccttccaaatctctcaaaagatcagtatcttttattttaagttatctccatctgcaaagcaactgatgatattcctgaaaccccttctttgattttggaatgtagaacctaacctcaccactgaaggaaagcacatgacctctaatctagcctctgcttaattcaggcagttttgttttgtttaataaaaaacagactcctgagcactagaagcagtttgttttgcagctgtctcaatgtgctttacttgggatgaggcaggtggcggagagcggccggaaagactctataacccagttgtgggaagaactccaagctgggagtcagtcacactgactctaccacttactagctgtgtaaccacaggcaagttactcaccccgtccaaacctcagttttctcttc

SEQ ID NO: 355308 - DNA, 1655 bp, Homo sapiens
aggccctgaactatttaaggatccaggtgttgcaaggcggtaagttttgcagccagtgtccatgaggtcggggctgggactagattagggtagatctaagcctgggcttgggagtgcagctagcgcagaaagatctgaggaactagagcaaaaagccatgcggatggattgtggtcgtcagaggctcccgtagtctttagcggcgctggcttccgcaggctccgccctctcttgcccacccggaaacagcctcgccccgcctacgcgggacccaaccgcggcgaccggacgtgcactcctccagtagcggctgcacgtcgtgccaatggcccgctatgaggaggtgagcgtgtccggcttcgaggagttccaccgggccgtggaacagcacaatggcaagaccattttcgcctactttacgggttctaaggacgccggggggaaaagctggtgccccgactgcgtgcagggtgaggccgggattcgggggctgctgtccaatggaaatggcaggaaggtcgagcctacggccagaaggggggcttagcggaggcagagtcttggttccagacatccgcggagcaatctgagctgtccccaagtctccttctattaaatcctaccccgccctgccaagagcgctcttccttttaccaccttacccggatgatcttggaatctagttccttaaaacttctcactcccccagtaccattagtgtcttacaggatacgtgagttgctgaaccagtcgtacgagaggggctgaagcacattagtgaaggatgtgtgttcatctactgccaagtaggagaaaagccttattggaaagatccaaataatgacttcagaaaaaacttgaaagtaacagcagtgcctacactacttaagtatggaacacctcaaaaactggtagaatctgagtgtcttcaggccaacctggtggaaatgttgttctctgaagattaagattttaggatggcaatcatgtcttgatgtcctgatttgttctagtatcaataaactgtatacttgctttgaattcatgttagcaataaatgatgttaaaaaaactggcatgtgtctaaacaatagagtgctattaaaatgcccatgaacctttagtttgcctgtaatacatggatatttttaagatataaagaagtcttcagaaatagcagtaaaggctcaaaggaacgtattcttgaaggtgacggaaatacctaaaaactcctaaaggtgcagagcacaccttccaaatctctcaaaagatcagtatcttttattttaagttatctccatctgcaaagcaactgatgatattcctgaaaccccttctttgattttggaatgtagaacctaacctcaccactgaaggaaagcacatgacctctaatctagcctctgcttaattcaggcagttttgttttgtttaataaaaaacagactcctgagcactagaagcagtttgttttgcagctgtctcaatgtgctttacttgggatgaggcaggtggcggagagcggccggaaagactctataacccagttgtgggaagaactccaagctgggagtcagtcacactgactctaccacttactagctgtgtaaccacaggcaagttactcaccccgtccaaacctcagttttctcttc

SEQ ID NO: 355309 - DNA, 236 bp, Homo sapiens
gcccccgccgccccggcagatgggccgccgcaactggcccgtgtgcgcttccggaagcgggcgactcgcagctccacgcgacgccgaggggctccgcgccgggaccgggcgggtgctcggagtttcggggaccgcacgggaccgagggcaggcgggcggccaccccccttacccccgcgtccggggcggggcgggcggcgcggggcggggccgggtgacgcggccccgccggggac

SEQ ID NO: 355310 - DNA, 3702 bp, Homo sapiens
gcccccgccgccccggcagatgggccgccgcaactggcccgtgtgcgcttccggaagcgggcgactcgcagctccacgcgacgccgaggggctccgcgccgggaccgggcgggtgctcggagtttcggggaccgcacgggaccgagggcaggaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatgttgccaactcctttggtacagccgtgggctctggtgtggtgaccttgaggcaggcatgcattttagcttcaatatttgaaaccaccggctccgtgttactaggcgccaaagtaggagaaaccattcgcaaaggtatcattgacgtgaacctgtacaacgagacggtggagactctcatggctggggaagttagtgccatggttggttccgctgtgtggcagctgattgcttccttcctgaggcttccaatctcaggaacgcactgcattgtgggttctactataggattctcactggtcgcaatcggtaccaaaggtgtgcagtggatggagcttgtcaagattgttgcttcttggtttatatctccactgttgtctggtttcatgtctggcctgctgtttgtactcatcagaattttcatcttaaaaaaggaagaccctgttcccaatggcctccgggcactcccagtattctatgctgctaccatagcaatcaatgtcttttccatcatgtacacaggagcaccagtgctcggccttgttctccccatgtgggccatagccctcatttcctttggtgtcgccctcctgttcgctttttttgtgtggctcttcgtgtgtccgtggatgcggaggaaaataacaggcaaattacaaaaagaaggtgctttatcacgagtatctgacgaaagcctcagtaaggttcaggaagcagagtccccagtatttaaagagctaccaggtgccaaggctaatgatgacagcaccatcccgctcacgggagcagcaggggagacactggggacctcggaaggcacttctgcgggcagccaccctcgggctgcatacggaagagcactgtccatgacccatggctctgtgaaatcgcccatctccaacggcaccttcggcttcgacggccacaccaggagcgacggtcatgtgtaccacaccgtgcacaaagactcggggctctacaaagatctgctgcacaaaatccacatcgacaggggccccgaggagaagccagcccaggaaagcaactaccggctgctgcgccgaaacaacagttacacctgctacaccgcagccatttgtgggctgccagtgcacgccacctttcgagctgcggactcatcggccccagaggacagtgagaagctggtgggcgacaccgtgtcctactccaagaagaggctgcgctacgacagctactcgagctactgtaacgcggtggcagaggcggagatcgaggcggaggagggcggcgtggagatgaagctggcgtcggagctggccgaccctgaccagccgcgagaggaccctgcagaggaggagaaggaggagaaggacgcacccgaggttcacctcctgttccatttcctgcaggtcctcaccgcctgtttcgggtcctttgctcacggcggcaatgacgtgagtaatgccatcggtcccctggtagccttgtggctgatttacaaacaaggcggggtaacgcaagaagcagctacacccgtctggctgctgttttatggaggagttggaatctgcacaggcctctgggtctgggggagaagagtgatccagaccatggggaaggacctcactcccatcacgccgtccagcggcttcacgatcgagctggcctcagccttcacagtggtgatcgcctccaacatcgggcttccagtcagcaccacgcactgtaaggtgggctcggtggtggccgtgggctggatccgctcccgcaaggctgtggactggcgcctctttcggaacatcttcgtggcctggttcgtgaccgtccctgtggctgggctgttcagcgctgctgtcatggctcttctcatgtatgggatccttccatatgtgtgatttgtcttcttccagctgcaaacagctaaagggatggtctggtgttggcgtgtgggagacatgtgtgctcgtgccgcacatacacatcctggccgtgcacggctctctcatgaccagctctctgcctcccttccaggaggctccatcccacactgttcacccaggctgcggagactcaccttcccgagctaacttaactactgtacataataatatgtattaaactggtatcgtggtgatataatgtggtgcagttacttatatattaaatatctattgtatccatagaataggcagcattatttcaaacatattcaagttgggagtggagatcattgcctagaagtcaatattcaataaatcttgtacataactatttcgatggcaaatgttaagccttctaaaaggaaagtgtagattggaaaatgattttttttccaaatgatgtttttgccttctaatatactgtaaggtaatgagcttcagaacaggcaacctgaccctgcagaggtcgcgtgctgtgggatgacagcgggacgggagctcacaagtgctttcactgaagatttgttcatatactgtgtattgattgttgtgtaatatatcatcattgcttttgtaaatacgtaaaactgtaattttttaatggtgtgcttcccttatacttttttgatcagagaattttggaaagtaccaaagaagcaggggaatcattggccagtgttacgttttcacattgtctgtctcccaccctcactgatcacgcctgccccagagcagtgtgtggcggtgacaccgtcacccagcatgcgccacgccgtggctcccaccagcagtgccaccgccaccacaccccagatcccacccaccttgcagtggcctttccttgtcatcagagtagagaatgcacaggtgttggtgagggcgtgtggctgagcactacatgtcaagtccagagtcagtttctatcccaattctccctgcagcctgaagaacggatccttgtctccaatgtcagcacaaaggaggctttttctgtgctttgacattctagcacttcagggatgagagggagggagaatcctggatgctggatggagtatttctctgaggcccacacaaagctggacacccccaggctctactccatcccattggagtctcttctttttttgatagcgggagggaggaagtacgactaatgttggagcctgaaactatggaaatgctgctaaaatttttatattgacaaacattttcttggtacttcattgtcatttttcattaatcaaccatattaaatttataataaaaaatgcccctcagaa

SEQ ID NO: 355311 - DNA, 3681 bp, Homo sapiens
acgcggggccactcacgctgccggctccggaggcggcacgcggccagcgctgctccgctccggggctctttaccccggagtcggggccgggcgcgcgggaaacggttaccgagcggacctggacgccctctgccttcgtcatttcctgccggccggtcggtttccggatgaaacgaggagccaggaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatgttgccaactcctttggtacagccgtgggctctggtgtggtgaccttgaggcaggcatgcattttagcttcaatatttgaaaccaccggctccgtgttactaggcgccaaagtaggagaaaccattcgcaaaggtatcattgacgtgaacctgtacaacgagacggtggagactctcatggctggggaagttagtgccatggttggttccgctgtgtggcagctgattgcttccttcctgaggcttccaatctcaggaacgcactgcattgtgggttctactataggattctcactggtcgcaatcggtaccaaaggtgtgcagtggatggagcttgtcaagattgttgcttcttggtttatatctccactgttgtctggtttcatgtctggcctgctgtttgtactcatcagaattttcatcttaaaaaaggaagaccctgttcccaatggcctccgggcactcccagtattctatgctgctaccatagcaatcaatgtcttttccatcatgtacacaggagcaccagtgctcggccttgttctccccatgtgggccatagccctcatttcctttggtgtcgccctcctgttcgctttttttgtgtggctcttcgtgtgtccgtggatgcggaggaaaataacaggcaaattacaaaaagaaggtgctttatcacgagtatctgacgaaagcctcagtaaggttcaggaagcagagtccccagtatttaaagagctaccaggtgccaaggctaatgatgacagcaccatcccgctcacgggagcagcaggggagacactggggacctcggaaggcacttctgcgggcagccaccctcgggctgcatacggaagagcactgtccatgacccatggctctgtgaaatcgcccatctccaacggcaccttcggcttcgacggccacaccaggagcgacggtcatgtgtaccacaccgtgcacaaagactcggggctctacaaagatctgctgcacaaaatccacatcgacaggggccccgaggagaagccagcccaggaaagcaactaccggctgctgcgccgaaacaacagttacacctgctacaccgcagccatttgtgggctgccagtgcacgccacctttcgagctgcggactcatcggccccagaggacagtgagaagctggtgggcgacaccgtgtcctactccaagaagaggctgcgctacgacagctactcgagctactgtaacgcggtggcagaggcggagatcgaggcggaggagggcggcgtggagatgaagctggcgtcggagctggccgaccctgaccagccgcgagaggaccctgcagaggaggagaaggaggagaaggacgcacccgaggttcacctcctgttccatttcctgcaggtcctcaccgcctgtttcgggtcctttgctcacggcggcaatgacgtgagtaatgccatcggtcccctggtagccttgtggctgatttacaaacaaggcggggtaacgcaagaagcagctacacccgtctggctgctgttttatggaggagttggaatctgcacaggcctctgggtctgggggagaagagtgatccagaccatggggaaggacctcactcccatcacgccgtccagcggcttcacgatcgagctggcctcagccttcacagtggtgatcgcctccaacatcgggcttccagtcagcaccacgcactgtaaggtgggctcggtggtggccgtgggctggatccgctcccgcaaggctgtggactggcgcctctttcggaacatcttcgtggcctggttcgtgaccgtccctgtggctgggctgttcagcgctgctgtcatggctcttctcatgtatgggatccttccatatgtgtgatttgtcttcttccagctgcaaacagctaaagggatggtctggtgttggcgtgtgggagacatgtgtgctcgtgccgcacatacacatcctggccgtgcacggctctctcatgaccagctctctgcctcccttccaggaggctccatcccacactgttcacccaggctgcggagactcaccttcccgagctaacttaactactgtacataataatatgtattaaactggtatcgtggtgatataatgtggtgcagttacttatatattaaatatctattgtatccatagaataggcagcattatttcaaacatattcaagttgggagtggagatcattgcctagaagtcaatattcaataaatcttgtacataactatttcgatggcaaatgttaagccttctaaaaggaaagtgtagattggaaaatgattttttttccaaatgatgtttttgccttctaatatactgtaaggtaatgagcttcagaacaggcaacctgaccctgcagaggtcgcgtgctgtgggatgacagcgggacgggagctcacaagtgctttcactgaagatttgttcatatactgtgtattgattgttgtgtaatatatcatcattgcttttgtaaatacgtaaaactgtaattttttaatggtgtgcttcccttatacttttttgatcagagaattttggaaagtaccaaagaagcaggggaatcattggccagtgttacgttttcacattgtctgtctcccaccctcactgatcacgcctgccccagagcagtgtgtggcggtgacaccgtcacccagcatgcgccacgccgtggctcccaccagcagtgccaccgccaccacaccccagatcccacccaccttgcagtggcctttccttgtcatcagagtagagaatgcacaggtgttggtgagggcgtgtggctgagcactacatgtcaagtccagagtcagtttctatcccaattctcctctgtgctttgacattctagcacttcagggatgagagggagggagaatcctggatgctggatggagtatttctctgaggcccacacaaagctggacacccccaggctctactccatcccattggagtctcttctttttttgatagcgggagggaggaagtacgactaatgttggagcctgaaactatggaaatgctgctaaaatttttatattgacaaacattttcttggtacttcattgtcatttttcattaatcaaccatattaaatttataataaaaaatgcccctcagaa

SEQ ID NO: 355312 - DNA, 3018 bp, Homo sapiens
atgctgttttttgaggcccgagcttggggcaggggttttttgaccctgcattggcagtgtggtcagtggtgtgtgactgtgtgttgatgtttgagtgtggccataaatgtgtgaaggtcagctctgccaagtcacagggcttgttaggttctgaattaaagttgcttcttggtttatatctccactgttgtctggtttcatgtctggcctgctgtttgtactcatcagaattttcatcttaaaaaaggaagaccctgttcccaatggcctccgggcactcccagtattctatgctgctaccatagcaatcaatgtcttttccatcatgtacacaggagcaccagtgctcggccttgttctccccatgtgggccatagccctcatttcctttggtgtcgccctcctgttcgctttttttgtgtggctcttcgtgtgtccgtggatgcggaggaaaataacaggcaaattacaaaaagaaggtgctttatcacgagtatctgacgaaagcctcagtaaggttcaggaagcagagtccccagtatttaaagagctaccaggtgccaaggctaatgatgacagcaccatcccgctcacgggagcagcaggggagacactggggacctcggaaggcacttctgcgggcagccaccctcgggctgcatacggaagagcactgtccatgacccatggctctgtgaaatcgcccatctccaacggcaccttcggcttcgacggccacaccaggagcgacggtcatgtgtaccacaccgtgcacaaagactcggggctctacaaagatctgctgcacaaaatccacatcgacaggggccccgaggagaagccagcccaggaaagcaactaccggctgctgcgccgaaacaacagttacacctgctacaccgcagccatttgtgggctgccagtgcacgccacctttcgagctgcggactcatcggccccagaggacagtgagaagctggtgggcgacaccgtgtcctactccaagaagaggctgcgctacgacagctactcgagctactgtaacgcggtggcagaggcggagatcgaggcggaggagggcggcgtggagatgaagctggcgtcggagctggccgaccctgaccagccgcgagaggaccctgcagaggaggagaaggaggagaaggacgcacccgaggttcacctcctgttccatttcctgcaggtcctcaccgcctgtttcgggtcctttgctcacggcggcaatgacgtgagtaatgccatcggtcccctggtagccttgtggctgatttacaaacaaggcggggtaacgcaagaagcagctacacccgtctggctgctgttttatggaggagttggaatctgcacaggcctctgggtctgggggagaagagtgatccagaccatggggaaggacctcactcccatcacgccgtccagcggcttcacgatcgagctggcctcagccttcacagtggtgatcgcctccaacatcgggcttccagtcagcaccacgcactgtaaggtgggctcggtggtggccgtgggctggatccgctcccgcaaggctgtggactggcgcctctttcggaacatcttcgtggcctggttcgtgaccgtccctgtggctgggctgttcagcgctgctgtcatggctcttctcatgtatgggatccttccatatgtgtgatttgtcttcttccagctgcaaacagctaaagggatggtctggtgttggcgtgtgggagacatgtgtgctcgtgccgcacatacacatcctggccgtgcacggctctctcatgaccagctctctgcctcccttccaggaggctccatcccacactgttcacccaggctgcggagactcaccttcccgagctaacttaactactgtacataataatatgtattaaactggtatcgtggtgatataatgtggtgcagttacttatatattaaatatctattgtatccatagaataggcagcattatttcaaacatattcaagttgggagtggagatcattgcctagaagtcaatattcaataaatcttgtacataactatttcgatggcaaatgttaagccttctaaaaggaaagtgtagattggaaaatgattttttttccaaatgatgtttttgccttctaatatactgtaaggtaatgagcttcagaacaggcaacctgaccctgcagaggtcgcgtgctgtgggatgacagcgggacgggagctcacaagtgctttcactgaagatttgttcatatactgtgtattgattgttgtgtaatatatcatcattgcttttgtaaatacgtaaaactgtaattttttaatggtgtgcttcccttatacttttttgatcagagaattttggaaagtaccaaagaagcaggggaatcattggccagtgttacgttttcacattgtctgtctcccaccctcactgatcacgcctgccccagagcagtgtgtggcggtgacaccgtcacccagcatgcgccacgccgtggctcccaccagcagtgccaccgccaccacaccccagatcccacccaccttgcagtggcctttccttgtcatcagagtagagaatgcacaggtgttggtgagggcgtgtggctgagcactacatgtcaagtccagagtcagtttctatcccaattctccctgcagcctgaagaacggatccttgtctccaatgtcagcacaaaggaggctttttctgtgctttgacattctagcacttcagggatgagagggagggagaatcctggatgctggatggagtatttctctgaggcccacacaaagctggacacccccaggctctactccatcccattggagtctcttctttttttgatagcgggagggaggaagtacgactaatgttggagcctgaaactatggaaatgctgctaaaatttttatattgacaaacattttcttggtacttcattgtcatttttcattaatcaaccatattaaatttataataaaaaatgcccctcagaa

SEQ ID NO: 355313 - DNA, 3678 bp, Homo sapiens
acgcggggccactcacgctgccggctccggaggcggcacgcggccagcgctgctccgctccggggctctttaccccggagtcggggccgggcgcgcgggaaacggttaccgagcggacctggacgccctctgccttcgtcatttcctgccggccggtcggtttccggatgaaacgaggagccaggaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatgttgccaactcctttggtacagccgtgggctctggtgtggtgaccttgaggcaggcatgcattttagcttcaatatttgaaaccaccggctccgtgttactaggcgccaaagtaggagaaaccattcgcaaaggtatcattgacgtgaacctgtacaacgagacggtggagactctcatggctggggaagttagtgccatggttggttccgctgtgtggcagctgattgcttccttcctgaggcttccaatctcaggaacgcactgcattgtgggttctactataggattctcactggtcgcaatcggtaccaaaggtgtgcagtggatggagcttgtcaagattgttgcttcttggtttatatctccactgttgtctggtttcatgtctggcctgctgtttgtactcatcagaattttcatcttaaaaaaggaagaccctgttcccaatggcctccgggcactcccagtattctatgctgctaccatagcaatcaatgtcttttccatcatgtacacaggagcaccagtgctcggccttgttctccccatgtgggccatagccctcatttcctttggtgtcgccctcctgttcgctttttttgtgtggctcttcgtgtgtccgtggatgcggaggaaaataacaggcaaattacaaaaagaaggtgctttatcacgagtatctgacgaaagcctcagtaaggttcaggaagcagagtccccagtatttaaagagctaccaggtgccaaggctaatgatgacagcaccatcccgctcacgggagcagcaggggagacactggggacctcggaaggcacttctgcgggcagccaccctcgggctgcatacggaagagcactgtccatgacccatggctctgtgaaatcgcccatctccaacggcaccttcggcttcgacggccacaccaggagcgacggtcatgtgtaccacaccgtgcacaaagactcggggctctacaaagatctgctgcacaaaatccacatcgacaggggccccgaggagaagccagcccaggaaagcaactaccggctgctgcgccgaaacaacagttacacctgctacaccgcagccatttgtgggctgccagtgcacgccacctttcgagctgcggactcatcggccccagaggacagtgagaagctggtgggcgacaccgtgtcctactccaagaagaggctgcgctacgacagctactcgagctactgtaacgcggtggcagaggcggagatcgaggcggaggagggcggcgtggagatgaagctggcgtcggagctggccgaccctgaccagccgcgagaggaccctgcagaggaggagaaggaggagaaggacgcacccgaggttcacctcctgttccatttcctgcaggtcctcaccgcctgtttcgggtcctttgctcacggcggcaatgacgtgagtaatgccatcggtcccctggtagccttgtggctgatttacaaacaaggcggggtaacgcaagaagcagctacacccgtctggctgctgttttatggaggagttggaatctgcacaggcctctgggtctgggggagaagagtgatccagaccatggggaaggacctcactcccatcacgccgtccagcggcttcacgatcgagctggcctcagccttcacagtggtgatcgcctccaacatcgggcttccagtcagcaccacgcactgtaaggtgggctcggtggtggccgtgggctggatccgctcccgcaaggctgtggactggcgcctctttcggaacatcttcgtggcctggttcgtgaccgtccctgtggctgggctgttcagcgctgctgtcatggctcttctcatgtatgggatccttccatatgtgtgatttgtcttcttccagctgcaaacagctaaagggatggtctggtgttggcgtgtgggagacatgtgtgctcgtgccgcacatacacatcctggccgtgcacggctctctcatgaccagctctctgcctcccttccaggaggctccatcccacactgttcacccaggctgcggagactcaccttcccgagctaacttaactactgtacataataatatgtattaaactggtatcgtggtgatataatgtggtgcagttacttatatattaaatatctattgtatccatagaataggcagcattatttcaaacatattcaagttgggagtggagatcattgcctagaagtcaatattcaataaatcttgtacataactatttcgatggcaaatgttaagccttctaaaaggaaagtgtagattggaaaatgattttttttccaaatgatgtttttgccttctaatatactgtaaggtaatgagcttcagaacaggcaacctgaccctgcagaggtcgcgtgctgtgggatgacagcgggacgggagctcacaagtgctttcactgaagatttgttcatatactgtgtattgattgttgtgtaatatatcatcattgcttttgtaaaattttggaaagtaccaaagaagcaggggaatcattggccagtgttacgttttcacattgtctgtctcccaccctcactgatcacgcctgccccagagcagtgtgtggcggtgacaccgtcacccagcatgcgccacgccgtggctcccaccagcagtgccaccgccaccacaccccagatcccacccaccttgcagtggcctttccttgtcatcagagtagagaatgcacaggtgttggtgagggcgtgtggctgagcactacatgtcaagtccagagtcagtttctatcccaattctccctgcagcctgaagaacggatccttgtctccaatgtcagcacaaaggaggctttttctgtgctttgacattctagcacttcagggatgagagggagggagaatcctggatgctggatggagtatttctctgaggcccacacaaagctggacacccccaggctctactccatcccattggagtctcttctttttttgatagcgggagggaggaagtacgactaatgttggagcctgaaactatggaaatgctgctaaaatttttatattgacaaacattttcttggtacttcattgtcatttttcattaatcaaccatattaaatttataataaaaaatgcccctcagaa

SEQ ID NO: 355314 - DNA, 3599 bp, Homo sapiens
acgcggggccactcacgctgccggctccggaggcggcacgcggccagcgctgctccgctccggggctctttaccccggagtcggggccgggcgcgcgggaaacggttaccgagcggacctggacgccctctgccttcgtcatttcctgccggccggtcggtttccggatgaaacgaggagccaggaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatgttgccaactcctttggtacagccgtgggctctggtgtggtgaccttgaggcaggcatgcattttagcttcaatatttgaaaccaccggctccgtgttactaggcgccaaagtaggagaaaccattcgcaaaggtatcattgacgtgaacctgtacaacgagacggtggagactctcatggctggggaagttagtgccatggttggttccgctgtgtggcagctgattgcttccttcctgaggcttccaatctcaggaacgcactgcattgtgggttctactataggattctcactggtcgcaatcggtaccaaaggtgtgcagtggatggagcttgtcaagattgttgcttcttggtttatatctccactgttgtctggtttcatgtctggcctgctgtttgtactcatcagaattttcatcttaaaaaaggaagaccctgttcccaatggcctccgggcactcccagtattctatgctgctaccatagcaatcaatgtcttttccatcatgtacacaggagcaccagtgctcggccttgttctccccatgtgggccatagccctcatttcctttggtgtcgccctcctgttcgctttttttgtgtggctcttcgtgtgtccgtggatgcggaggaaaataacaggcaaattacaaaaagaaggtgctttatcacgagtatctgacgaaagcctcagtaaggttcaggaagcagagtccccagtatttaaagagctaccaggtgccaaggctaatgatgacagcaccatcccgctcacgggagcagcaggggagacactggggacctcggaaggcacttctgcgggcagccaccctcgggctgcatacggaagagcactgtccatgacccatggctctgtgaaatcgcccatctccaacggcaccttcggcttcgacggccacaccaggagcgacggtcatgtgtaccacaccgtgcacaaagactcggggctctacaaagatctgctgcacaaaatccacatcgacaggggccccgaggagaagccagcccaggaaagcaactaccggctgctgcgccgaaacaacagttacacctgctacaccgcagccatttgtgggctgccagtgcacgccacctttcgagctgcggactcatcggccccagaggacagtgagaagctggtgggcgacaccgtgtcctactccaagaagaggctgcgctacgacagctactcgagctactgtaacgcggtggcagaggcggagatcgaggcggaggagggcggcgtggagatgaagctggcgtcggagctggccgaccctgaccagccgcgagaggaccctgcagaggaggagaaggaggagaaggacgcacccgaggttcacctcctgttccatttcctgcaggtcctcaccgcctgtttcgggtcctttgctcacggcggcaatgacgtgagtaatgccatcggtcccctggtagccttgtggctgatttacaaacaaggcggggtaacgcaagaagcagctacacccgtctggctgctgttttatggaggagttggaatctgcacaggcctctgggtctgggggagaagagtgatccagaccatggggaaggacctcactcccatcacgccgtccagcggcttcacgatcgagctggcctcagccttcacagtggtgatcgcctccaacatcgggcttccagtcagcaccacgcactgtaaggtgggctcggtggtggccgtgggctggatccgctcccgcaaggctgtggactggcgcctctttcggaacatcttcgtggcctggttcgtgaccgtccctgtggctgggctgttcagcgctgctgtcatggctcttctcatgtatgggatccttccatatgtgtgatttgtcttcttccagctgcaaacagctaaagggatggtctggtgttggcgtgtgggagacatgtgtgctcgtgccgcacatacacatcctggccgtgcacggctctctcatgaccagctctctgcctcccttccaggaggctccatcccacactgttcacccaggctgcggagactcaccttcccgagctaacttaactactgtacataataatatgtattaaactggtatcgtggtgatataatgtggtgcagttacttatatattaaatatctattgtatccatagaataggcagcattatttcaaacatattcaagttgggagtggagatcattgcctagaagtcaatattcaataaatcttgtacataactatttcgatggcaaatgttaagccttctaaaaggaaagtgtagattggaaaatgattttttttccaaatgatgtttttgccttctaatatactgtaaggtaatgagcttcagaacaggcaacctgaccctgcagaggtcgcgtgctgtgggatgacagcgggacgggagctcacaagtgctttcactgaaatacgtaaaactgtaattttttaatggtgtgcttcccttatacttttttgatcagagaattttggaaagtaccaaagaagcaggggaatcattggccagtgttacgttttcacattgtctgtctcccacccagcagtgccaccgccaccacaccccagatcccacccaccttgcagtggcctttccttgtcatcagagtagagaatgcacaggtgttggtgagggcgtgtggctgagcactacatgtcaagtccagagtcagtttctatcccaattctccctgcagcctgaagaacggatccttgtctccaatgtcagcacaaaggaggctttttctgtgctttgacattctagcacttcagggatgagagggagggagaatcctggatgctggatggagtatttctctgaggcccacacaaagctggacacccccaggctctactccatcccattggagtctcttctttttttgatagcgggagggaggaagtacgactaatgttggagcctgaaactatggaaatgctgctaaaatttttatattgacaaacattttcttggtacttcattgtcatttttcattaatcaaccatattaaatttataataaaaaatgcccctcagaa

SEQ ID NO: 355315 - DNA, 6164 bp, Homo sapiens
  misc_feature (1449)..(1449): n is a, c, g, or t
  misc_feature (1987)..(1987): n is a, c, g, or t
  misc_feature (1990)..(1990): n is a, c, g, or t
  misc_feature (2070)..(2070): n is a, c, g, or t
acgcggggccactcacgctgccggctccggaggcggcacgcggccagcgctgctccgctccggggctctttaccccggagtcggggccgggcgcgcgggaaacggttaccgagcggacctggacgccctctgccttcgtcatttcctgccggccggtcggtttccggatgaaacgaggagccaggcatctccttggaaacaatgccatctttgaatgtgagagataaacctagtttcagcatgtctgcagcagagaccagtacatcaggcttattcccacaggaagcctcctaaagcctgtggcgcggcaaccatttccaggactaaataataatgtgtcagatgcctgtgagtggactgcctggccaaatgactcatgaagatattcacggaagaatagtcaaaaaccaaagaaaaggcatattctagaagcaccttcaattccatcgaggatttttgagcagctgaagaagaaagttctgaaaatatgagtgacaggactccagcacattttttttagttgtttcttacattatctttgttaacccatccgcttttgtgtataatattaagttattttccactactgcaatggctagtaatttacttaggctcagagttttactctgtatggacagagaaataggaggtaacaacagtgggagaacaaataggaacagttcactgggatgttggtccccagaaattggctttcattgaataattcctaaagggtgtcgtgtgctgaattgctttttcatagtgatgtgctgcttcttgttcatactcttatgactttaatttcacctttatctactcccagcctctgtatatgcctacgtttttaaaaataatttttggcactgaagatctgattaccatattttttcagtttaaaaattaaatcctcgcaaatagacctttggtatagttgcattctaccctaggttattttctaggatcaagaatagaacaatttctgttctttccagcattactctttactattcatatgttcttgttcagtgttttgttgttctcatattctaggtggaaatgaagggtaatctctatgttctattttcagttttctaggaaaccagaaaaacatgggtagtagaaatgtatagaaaatgtatgaggtctcttaaccattgtgttaaacttgcattaagcttcttttttagcaatatcgatgtcagtgttacctcttctttcctttttatttattttttttgagacagagtctcattctgtcgcccagactggttggagtgcgatgatgcgatcgcggctaactgcaaccgctgcctcccgggtacaagtgattctcgtgccttgggctcccgagtagctgggatttttagtggagaacaggtttcaccatattggccaggctggtcttgaactcgcaacctcaggtgatccacccacctcagcctccccaangtgttgggattacaggcatgagccaccatacctggccccttttgttgttttgaggggcaggcagtaagaagcagggatttcttcaaatgctagtaagcacaaagagagggagaagtttttgtaagtaacgaacagggccgggcatggtggcgtgagaggccgaggtgggcagatcacgaggtcaggagttcgagaccagcctgaccaacatggtgaaacccccgtctccactagaaatgcaaagattagccgggcatggtggtgcacgcctgtaatccagctagtcgggaggctgaggcaggagaatcgcttgaacctgggaggtggaggttgcagggagctgagatcacgccactgcactccagcctgggcgacagagtaagactcccgtctcaaaaaaaaaaaaaaaaaaaaaagaacagttgatcattaaggccattaatgtgcatggacagtttgttgcccaggttggagtgtgatgacgacgcaatctcggtaaatataaacctactctgtaacctccacctcctgggctcangcngttctcgtgcttcagcctcccgagtagctgggatcacaggcatgcgccactaagcccagctaatttttgtatttttagtngagacggggtttcaccatgttggccaggctggtcttgaactcctggcctcaagtgatgcgcctgcctgggcctcccaaagtgctgggattacaggtgtgagccactgcacctggcccaataggcacatttttttaataagtagtttgttgattagaacgaagagcacttgccgtaagtgcatgtcattgttttcagctgttatggctaagtcagttaacctcatcaacaattttttcttctgtaaattgaggacaatttttgcttttatgaatgaagtcttaaccagcaggaagaaatataaacaaaggaacatatttttaatttaatgaagcaaaattccatacatcattttgaaaatagtgtttctttccctgataggcctgttctgcatcattcttttagcttccttctgccctgtttatcacttggtcccacttttatatttttcctcttcggtccagaatttcttatttagtttcttgtattttgcctactccctcccttctccatgattcagcctagtctttccgtcctctgtggacttgggtgtgccttcctctgggccacctcgtcttttgctgctgttagccctcccgcctgcgcacctgccacttcaccctcgcctgtggtccacttacgttccactcagcccggtcagtcctgctttgttcttctccaccgccttggtctcccgtgtgtcttatctagctctggttccttctcgtctccacatttattttgttttcttcctgtgcttgttagtccttgtgcacttggtccttgagctctttttctattaataggtattactagatggatttgttgtctgcctttacatagaacacacatccttactgtgcatttcctgggtagccaggatgaatcaattattattaacttcccttcgaacattgagcttcctctgttttctgtttctaagaattagattagtattctagaagactaatactactttaaagacagtcaaaacagtcatacgctgccatttcagccctttatttaagagtttgtgacatttatcactcccttgaaagattaaagaacacccaaagcaagtttggggtggaggtggggaaggcaggaagagaaaggtaagtgctataaaaggactcattgttaatttctagaaattggactgagatctgaaagcataagccttaacattttttagataaacggtccctgaaaagaataaaaagtatcagtacttccgttaactagctttagtattgggtcatttgtagtttacattctcctttaagttttaagaccttcagtagttaacaaagcagacagagactggccaggcacagtggctcacacctgtaataccagcactttgggaggctgagttgggtggatcacaaggtcaggagattgaaaccatcctggccaacatggtgaaaccccgtctctactaaaaatacaaaaaaaaaaaaaaattagccaggcgtggtggcaggcacctgtggtcccagctactcgggaggctggggcaggagaatttcttgagcccgggaggccgaggttgcagtgagctgagatcgcgccactgcactccagcctgggtgacagcgagactctgtctcaaaaagaaaaaaaaaaaaaaaagcagagacttaatcttgtaaatactcattttatttttgagaggcttaatgtctccttaaatattaacctgtgtcattttgtaattatactgtaatagtgtcagaatgccattaacaaccaacccttttcgtttcttgtgtgggaaagctcataaattgtgtggtcttacccctctggaccctgtagttgtagcattgtgaaaatggagcttttggcaaaactttgtattatgctgttgactcacattgtctcatatttttcctttattcttctatattctatgaatatggtgctgtcctgtcatttaattattataatatatgtgaactgctggaggtagactgatgtgagtgcagtttttcaacttaaaaacccttatatatcacattcatggtgtttaagatataagaacagccctacaaagaggggttgattgtattgaagattctttctgctgagcctgccttaattgtgagggtggttgtttgggtatcttagagctaaaagaatggctaagagtccattaatggtcctgtaatattcaccatccctgagcagttagtaaagaatggccgcaaagccacaattaggctactaacaaggaacttatgtagatgtgctaggtccagcctgtgttctggaactatagagatgaataaggtatggtcctttctctctggaggctcacagttgaatagggaatattaatacgtgaatgatagcagtacagtgtggcagatgctaaaatatatgtgtgtagcagctattacaggagaactgattaatagggagagtctggctgggctcagtgactcacccctgtaatcccagcactttgggaggccgaggcgggcagatcacttgaggtcaggagttcgagaccagcctggccaacatggtaaaacctcatctctactaaaaaatacaaagaaaattagcaaggcgtggtggcgggcatctgtaatcccagctactggggaggctgaagcaggagaatcccttgaacccgggaggtgaggttgcagtgagctgagatcatgccactgcactccagcctgggtgacagagtaagactgtctcaaaaacaaaacccaaaatactaaccatatttatagttagtcacctcaccctttttttagttaaaagaagtttatttagcctgatcagtttaccagatgtcttttttagtgacttttgtgtcttccataaatccattctcaaaatttgcaacagttgagcatatttgaccaaaatgtgccacaggtttctgaagcctgttcaagaagaagcatgtcaacattattggagtaggtcttcgcaatgactacttttgggaagatttgagtaaaatttatggatacagaagttttggagtatgttagaatattactaagtctttttatagttgtaatcccaacactgggttatatatatttaataccaacctgagtatatttcctgaataatatctgttttggagacttggacaaagttaacttttttgcttttttaaaagttgctgtttaaattaacttcctgcatttctaatgtagaaaaaatatggcacagtgatttgaattttgtttatggtttattatcttcctaaattatcagctctttaaaatatgggtctctggcctgtataccatctgataaattaggttgggtaaatttttcacctgaaaaaattcattcttttgacccaggttgtttggcttggaaaaaaaaaatcacatactcattgcatgattaaacttgtccatcagattgtgattttgtgcgttatgaggattgtagctggggtaattttaaaatgttggtatttggatagaactgccagcccaggattttgataaagatcaaaatatatactgtatctaaagtttcttttttaaaagttatttcacttataatcaaaaggtttaaataagtttagtgtatattttatgattagtattattttgtatcgattcagagagaggaaaactgcattcccatagacagggagacttggtgcattaatatccaaagcttagtttaagctggtgatgattagaaaagtggctttcatttgtgttctctggaagattctcagtagtcctgtgggcatgtgaacaagagcatgtgtaatcttcataatgtatgtcttgttagcagaaatgtctgaggcattgctgagatgtaggatgagctgaggtactggttttgtctttcatggttccctattatgttttttgagaaactgagcttttcctgacagtgtttagtttttcttggctatttactatgctattaatagtaacagtttccattatggagcctcagtaggttcttgacatacattaacccattgctattatgtaattttctaataaaatgatgtgataaaacatattttctgtaatatactcatagaatatgtgattataagtaaataaatagatgttggggtagtcctcca

SEQ ID NO: 355316 - DNA, 6219 bp, Homo sapiens
  misc_feature (1504)..(1504): n is a, c, g, or t
  misc_feature (2042)..(2042): n is a, c, g, or t
  misc_feature (2045)..(2045): n is a, c, g, or t
  misc_feature (2125)..(2125): n is a, c, g, or t
caagatgaagaacagtggtatttctctgaaagtcccagtatgtctcccttttgttgggagctgacagtatgattttgggggcatcgggcatcaacagtcactgaatctaaatggctccacagataggggagtgtatacatcaccacaccagctgtccaggaattaggaggaagtgcccttgaatgaagcctgggctgcaagcctggttagcagccagggaggacacacacacgttgcaggcatctccttggaaacaatgccatctttgaatgtgagagataaacctagtttcagcatgtctgcagcagagaccagtacatcaggcttattcccacaggaagcctcctaaagcctgtggcgcggcaaccatttccaggactaaataataatgtgtcagatgcctgtgagtggactgcctggccaaatgactcatgaagatattcacggaagaatagtcaaaaaccaaagaaaaggcatattctagaagcaccttcaattccatcgaggatttttgagcagctgaagaagaaagttctgaaaatatgagtgacaggactccagcacattttttttagttgtttcttacattatctttgttaacccatccgcttttgtgtataatattaagttattttccactactgcaatggctagtaatttacttaggctcagagttttactctgtatggacagagaaataggaggtaacaacagtgggagaacaaataggaacagttcactgggatgttggtccccagaaattggctttcattgaataattcctaaagggtgtcgtgtgctgaattgctttttcatagtgatgtgctgcttcttgttcatactcttatgactttaatttcacctttatctactcccagcctctgtatatgcctacgtttttaaaaataatttttggcactgaagatctgattaccatattttttcagtttaaaaattaaatcctcgcaaatagacctttggtatagttgcattctaccctaggttattttctaggatcaagaatagaacaatttctgttctttccagcattactctttactattcatatgttcttgttcagtgttttgttgttctcatattctaggtggaaatgaagggtaatctctatgttctattttcagttttctaggaaaccagaaaaacatgggtagtagaaatgtatagaaaatgtatgaggtctcttaaccattgtgttaaacttgcattaagcttcttttttagcaatatcgatgtcagtgttacctcttctttcctttttatttattttttttgagacagagtctcattctgtcgcccagactggttggagtgcgatgatgcgatcgcggctaactgcaaccgctgcctcccgggtacaagtgattctcgtgccttgggctcccgagtagctgggatttttagtggagaacaggtttcaccatattggccaggctggtcttgaactcgcaacctcaggtgatccacccacctcagcctccccaangtgttgggattacaggcatgagccaccatacctggccccttttgttgttttgaggggcaggcagtaagaagcagggatttcttcaaatgctagtaagcacaaagagagggagaagtttttgtaagtaacgaacagggccgggcatggtggcgtgagaggccgaggtgggcagatcacgaggtcaggagttcgagaccagcctgaccaacatggtgaaacccccgtctccactagaaatgcaaagattagccgggcatggtggtgcacgcctgtaatccagctagtcgggaggctgaggcaggagaatcgcttgaacctgggaggtggaggttgcagggagctgagatcacgccactgcactccagcctgggcgacagagtaagactcccgtctcaaaaaaaaaaaaaaaaaaaaaagaacagttgatcattaaggccattaatgtgcatggacagtttgttgcccaggttggagtgtgatgacgacgcaatctcggtaaatataaacctactctgtaacctccacctcctgggctcangcngttctcgtgcttcagcctcccgagtagctgggatcacaggcatgcgccactaagcccagctaatttttgtatttttagtngagacggggtttcaccatgttggccaggctggtcttgaactcctggcctcaagtgatgcgcctgcctgggcctcccaaagtgctgggattacaggtgtgagccactgcacctggcccaataggcacatttttttaataagtagtttgttgattagaacgaagagcacttgccgtaagtgcatgtcattgttttcagctgttatggctaagtcagttaacctcatcaacaattttttcttctgtaaattgaggacaatttttgcttttatgaatgaagtcttaaccagcaggaagaaatataaacaaaggaacatatttttaatttaatgaagcaaaattccatacatcattttgaaaatagtgtttctttccctgataggcctgttctgcatcattcttttagcttccttctgccctgtttatcacttggtcccacttttatatttttcctcttcggtccagaatttcttatttagtttcttgtattttgcctactccctcccttctccatgattcagcctagtctttccgtcctctgtggacttgggtgtgccttcctctgggccacctcgtcttttgctgctgttagccctcccgcctgcgcacctgccacttcaccctcgcctgtggtccacttacgttccactcagcccggtcagtcctgctttgttcttctccaccgccttggtctcccgtgtgtcttatctagctctggttccttctcgtctccacatttattttgttttcttcctgtgcttgttagtccttgtgcacttggtccttgagctctttttctattaataggtattactagatggatttgttgtctgcctttacatagaacacacatccttactgtgcatttcctgggtagccaggatgaatcaattattattaacttcccttcgaacattgagcttcctctgttttctgtttctaagaattagattagtattctagaagactaatactactttaaagacagtcaaaacagtcatacgctgccatttcagccctttatttaagagtttgtgacatttatcactcccttgaaagattaaagaacacccaaagcaagtttggggtggaggtggggaaggcaggaagagaaaggtaagtgctataaaaggactcattgttaatttctagaaattggactgagatctgaaagcataagccttaacattttttagataaacggtccctgaaaagaataaaaagtatcagtacttccgttaactagctttagtattgggtcatttgtagtttacattctcctttaagttttaagaccttcagtagttaacaaagcagacagagactggccaggcacagtggctcacacctgtaataccagcactttgggaggctgagttgggtggatcacaaggtcaggagattgaaaccatcctggccaacatggtgaaaccccgtctctactaaaaatacaaaaaaaaaaaaaaattagccaggcgtggtggcaggcacctgtggtcccagctactcgggaggctggggcaggagaatttcttgagcccgggaggccgaggttgcagtgagctgagatcgcgccactgcactccagcctgggtgacagcgagactctgtctcaaaaagaaaaaaaaaaaaaaaagcagagacttaatcttgtaaatactcattttatttttgagaggcttaatgtctccttaaatattaacctgtgtcattttgtaattatactgtaatagtgtcagaatgccattaacaaccaacccttttcgtttcttgtgtgggaaagctcataaattgtgtggtcttacccctctggaccctgtagttgtagcattgtgaaaatggagcttttggcaaaactttgtattatgctgttgactcacattgtctcatatttttcctttattcttctatattctatgaatatggtgctgtcctgtcatttaattattataatatatgtgaactgctggaggtagactgatgtgagtgcagtttttcaacttaaaaacccttatatatcacattcatggtgtttaagatataagaacagccctacaaagaggggttgattgtattgaagattctttctgctgagcctgccttaattgtgagggtggttgtttgggtatcttagagctaaaagaatggctaagagtccattaatggtcctgtaatattcaccatccctgagcagttagtaaagaatggccgcaaagccacaattaggctactaacaaggaacttatgtagatgtgctaggtccagcctgtgttctggaactatagagatgaataaggtatggtcctttctctctggaggctcacagttgaatagggaatattaatacgtgaatgatagcagtacagtgtggcagatgctaaaatatatgtgtgtagcagctattacaggagaactgattaatagggagagtctggctgggctcagtgactcacccctgtaatcccagcactttgggaggccgaggcgggcagatcacttgaggtcaggagttcgagaccagcctggccaacatggtaaaacctcatctctactaaaaaatacaaagaaaattagcaaggcgtggtggcgggcatctgtaatcccagctactggggaggctgaagcaggagaatcccttgaacccgggaggtgaggttgcagtgagctgagatcatgccactgcactccagcctgggtgacagagtaagactgtctcaaaaacaaaacccaaaatactaaccatatttatagttagtcacctcaccctttttttagttaaaagaagtttatttagcctgatcagtttaccagatgtcttttttagtgacttttgtgtcttccataaatccattctcaaaatttgcaacagttgagcatatttgaccaaaatgtgccacaggtttctgaagcctgttcaagaagaagcatgtcaacattattggagtaggtcttcgcaatgactacttttgggaagatttgagtaaaatttatggatacagaagttttggagtatgttagaatattactaagtctttttatagttgtaatcccaacactgggttatatatatttaataccaacctgagtatatttcctgaataatatctgttttggagacttggacaaagttaacttttttgcttttttaaaagttgctgtttaaattaacttcctgcatttctaatgtagaaaaaatatggcacagtgatttgaattttgtttatggtttattatcttcctaaattatcagctctttaaaatatgggtctctggcctgtataccatctgataaattaggttgggtaaatttttcacctgaaaaaattcattcttttgacccaggttgtttggcttggaaaaaaaaaatcacatactcattgcatgattaaacttgtccatcagattgtgattttgtgcgttatgaggattgtagctggggtaattttaaaatgttggtatttggatagaactgccagcccaggattttgataaagatcaaaatatatactgtatctaaagtttcttttttaaaagttatttcacttataatcaaaaggtttaaataagtttagtgtatattttatgattagtattattttgtatcgattcagagagaggaaaactgcattcccatagacagggagacttggtgcattaatatccaaagcttagtttaagctggtgatgattagaaaagtggctttcatttgtgttctctggaagattctcagtagtcctgtgggcatgtgaacaagagcatgtgtaatcttcataatgtatgtcttgttagcagaaatgtctgaggcattgctgagatgtaggatgagctgaggtactggttttgtctttcatggttccctattatgttttttgagaaactgagcttttcctgacagtgtttagtttttcttggctatttactatgctattaatagtaacagtttccattatggagcctcagtaggttcttgacatacattaacccattgctattatgtaattttctaataaaatgatgtgataaaacatattttctgtaatatactcatagaatatgtgattataagtaaataaatagatgttggggtagtcctcca

SEQ ID NO: 355317 - DNA, 6630 bp, Homo sapiens
  misc_feature (1846)..(1846): n is a, c, g, or t
  misc_feature (2384)..(2384): n is a, c, g, or t
  misc_feature (2387)..(2387): n is a, c, g, or t
  misc_feature (2467)..(2467): n is a, c, g, or t
agccggagagacgcagcggcggccccagtgccgcccccgggcgcgtgagtggagccgggctcctttcccctaccgcgccgcgacccccgcccgggctgcgcgcgccgcctcccgcgagcccccggcccgactcccgggctcccgcgggtgggggccagggctggtcggcgccggcggggctcgcggcggcggcgggttgcgtcccccgcgcctgctggcccacgtggacctggccgtcgcttgccgtgcggcgcctttgcgaaaactcgacggaagtggcagggaccgggcattacctgcgagtgccgggcgcctcctgctccgctgtgcgcgcttggggtgggactcggcgggggaggggtcgtgtacattgtcccaccaggcgcaatgtagccgggcggcgcagaggatttcttttttggtcttgagagcatagagtcccttttcatattcacgtgtactcttaagaaagcgtctgttctccaaactggctttccattctccccgtcctaaatggtgcgtggctgacaccgtagtgttttcaaaactggatatggccaggatgctatagcattgtcagtgcatctccttggaaacaatgccatctttgaatgtgagagataaacctagtttcagcatgtctgcagcagagaccagtacatcaggcttattcccacaggaagcctcctaaagcctgtggcgcggcaaccatttccaggactaaataataatgtgtcagatgcctgtgagtggactgcctggccaaatgactcatgaagatattcacggaagaatagtcaaaaaccaaagaaaaggcatattctagaagcaccttcaattccatcgaggatttttgagcagctgaagaagaaagttctgaaaatatgagtgacaggactccagcacattttttttagttgtttcttacattatctttgttaacccatccgcttttgtgtataatattaagttattttccactactgcaatggctagtaatttacttaggctcagagttttactctgtatggacagagaaataggaggtaacaacagtgggagaacaaataggaacagttcactgggatgttggtccccagaaattggctttcattgaataattcctaaagggtgtcgtgtgctgaattgctttttcatagtgatgtgctgcttcttgttcatactcttatgactttaatttcacctttatctactcccagcctctgtatatgcctacgtttttaaaaataatttttggcactgaagatctgattaccatattttttcagtttaaaaattaaatcctcgcaaatagacctttggtatagttgcattctaccctaggttattttctaggatcaagaatagaacaatttctgttctttccagcattactctttactattcatatgttcttgttcagtgttttgttgttctcatattctaggtggaaatgaagggtaatctctatgttctattttcagttttctaggaaaccagaaaaacatgggtagtagaaatgtatagaaaatgtatgaggtctcttaaccattgtgttaaacttgcattaagcttcttttttagcaatatcgatgtcagtgttacctcttctttcctttttatttattttttttgagacagagtctcattctgtcgcccagactggttggagtgcgatgatgcgatcgcggctaactgcaaccgctgcctcccgggtacaagtgattctcgtgccttgggctcccgagtagctgggatttttagtggagaacaggtttcaccatattggccaggctggtcttgaactcgcaacctcaggtgatccacccacctcagcctccccaangtgttgggattacaggcatgagccaccatacctggccccttttgttgttttgaggggcaggcagtaagaagcagggatttcttcaaatgctagtaagcacaaagagagggagaagtttttgtaagtaacgaacagggccgggcatggtggcgtgagaggccgaggtgggcagatcacgaggtcaggagttcgagaccagcctgaccaacatggtgaaacccccgtctccactagaaatgcaaagattagccgggcatggtggtgcacgcctgtaatccagctagtcgggaggctgaggcaggagaatcgcttgaacctgggaggtggaggttgcagggagctgagatcacgccactgcactccagcctgggcgacagagtaagactcccgtctcaaaaaaaaaaaaaaaaaaaaaagaacagttgatcattaaggccattaatgtgcatggacagtttgttgcccaggttggagtgtgatgacgacgcaatctcggtaaatataaacctactctgtaacctccacctcctgggctcangcngttctcgtgcttcagcctcccgagtagctgggatcacaggcatgcgccactaagcccagctaatttttgtatttttagtngagacggggtttcaccatgttggccaggctggtcttgaactcctggcctcaagtgatgcgcctgcctgggcctcccaaagtgctgggattacaggtgtgagccactgcacctggcccaataggcacatttttttaataagtagtttgttgattagaacgaagagcacttgccgtaagtgcatgtcattgttttcagctgttatggctaagtcagttaacctcatcaacaattttttcttctgtaaattgaggacaatttttgcttttatgaatgaagtcttaaccagcaggaagaaatataaacaaaggaacatatttttaatttaatgaagcaaaattccatacatcattttgaaaatagtgtttctttccctgataggcctgttctgcatcattcttttagcttccttctgccctgtttatcacttggtcccacttttatatttttcctcttcggtccagaatttcttatttagtttcttgtattttgcctactccctcccttctccatgattcagcctagtctttccgtcctctgtggacttgggtgtgccttcctctgggccacctcgtcttttgctgctgttagccctcccgcctgcgcacctgccacttcaccctcgcctgtggtccacttacgttccactcagcccggtcagtcctgctttgttcttctccaccgccttggtctcccgtgtgtcttatctagctctggttccttctcgtctccacatttattttgttttcttcctgtgcttgttagtccttgtgcacttggtccttgagctctttttctattaataggtattactagatggatttgttgtctgcctttacatagaacacacatccttactgtgcatttcctgggtagccaggatgaatcaattattattaacttcccttcgaacattgagcttcctctgttttctgtttctaagaattagattagtattctagaagactaatactactttaaagacagtcaaaacagtcatacgctgccatttcagccctttatttaagagtttgtgacatttatcactcccttgaaagattaaagaacacccaaagcaagtttggggtggaggtggggaaggcaggaagagaaaggtaagtgctataaaaggactcattgttaatttctagaaattggactgagatctgaaagcataagccttaacattttttagataaacggtccctgaaaagaataaaaagtatcagtacttccgttaactagctttagtattgggtcatttgtagtttacattctcctttaagttttaagaccttcagtagttaacaaagcagacagagactggccaggcacagtggctcacacctgtaataccagcactttgggaggctgagttgggtggatcacaaggtcaggagattgaaaccatcctggccaacatggtgaaaccccgtctctactaaaaatacaaaaaaaaaaaaaaattagccaggcgtggtggcaggcacctgtggtcccagctactcgggaggctggggcaggagaatttcttgagcccgggaggccgaggttgcagtgagctgagatcgcgccactgcactccagcctgggtgacagcgagactctgtctcaaaaagaaaaaaaaaaaaaaaagcagagacttaatcttgtaaatactcattttatttttgagaggcttaatgtctccttaaatattaacctgtgtcattttgtaattatactgtaatagtgtcagaatgccattaacaaccaacccttttcgtttcttgtgtgggaaagctcataaattgtgtggtcttacccctctggaccctgtagttgtagcattgtgaaaatggagcttttggcaaaactttgtattatgctgttgactcacattgtctcatatttttcctttattcttctatattctatgaatatggtgctgtcctgtcatttaattattataatatatgtgaactgctggaggtagactgatgtgagtgcagtttttcaacttaaaaacccttatatatcacattcatggtgtttaagatataagaacagccctacaaagaggggttgattgtattgaagattctttctgctgagcctgccttaattgtgagggtggttgtttgggtatcttagagctaaaagaatggctaagagtccattaatggtcctgtaatattcaccatccctgagcagttagtaaagaatggccgcaaagccacaattaggctactaacaaggaacttatgtagatgtgctaggtccagcctgtgttctggaactatagagatgaataaggtatggtcctttctctctggaggctcacagttgaatagggaatattaatacgtgaatgatagcagtacagtgtggcagatgctaaaatatatgtgtgtagcagctattacaggagaactgattaatagggagagtctggctgggctcagtgactcacccctgtaatcccagcactttgggaggccgaggcgggcagatcacttgaggtcaggagttcgagaccagcctggccaacatggtaaaacctcatctctactaaaaaatacaaagaaaattagcaaggcgtggtggcgggcatctgtaatcccagctactggggaggctgaagcaggagaatcccttgaacccgggaggtgaggttgcagtgagctgagatcatgccactgcactccagcctgggtgacagagtaagactgtctcaaaaacaaaacccaaaatactaaccatatttatagttagtcacctcaccctttttttagttaaaagaagtttatttagcctgatcagtttaccagatgtcttttttagtgacttttgtgtcttccataaatccattctcaaaatttgcaacagttgagcatatttgaccaaaatgtgccacaggtttctgaagcctgttcaagaagaagcatgtcaacattattggagtaggtcttcgcaatgactacttttgggaagatttgagtaaaatttatggatacagaagttttggagtatgttagaatattactaagtctttttatagttgtaatcccaacactgggttatatatatttaataccaacctgagtatatttcctgaataatatctgttttggagacttggacaaagttaacttttttgcttttttaaaagttgctgtttaaattaacttcctgcatttctaatgtagaaaaaatatggcacagtgatttgaattttgtttatggtttattatcttcctaaattatcagctctttaaaatatgggtctctggcctgtataccatctgataaattaggttgggtaaatttttcacctgaaaaaattcattcttttgacccaggttgtttggcttggaaaaaaaaaatcacatactcattgcatgattaaacttgtccatcagattgtgattttgtgcgttatgaggattgtagctggggtaattttaaaatgttggtatttggatagaactgccagcccaggattttgataaagatcaaaatatatactgtatctaaagtttcttttttaaaagttatttcacttataatcaaaaggtttaaataagtttagtgtatattttatgattagtattattttgtatcgattcagagagaggaaaactgcattcccatagacagggagacttggtgcattaatatccaaagcttagtttaagctggtgatgattagaaaagtggctttcatttgtgttctctggaagattctcagtagtcctgtgggcatgtgaacaagagcatgtgtaatcttcataatgtatgtcttgttagcagaaatgtctgaggcattgctgagatgtaggatgagctgaggtactggttttgtctttcatggttccctattatgttttttgagaaactgagcttttcctgacagtgtttagtttttcttggctatttactatgctattaatagtaacagtttccattatggagcctcagtaggttcttgacatacattaacccattgctattatgtaattttctaataaaatgatgtgataaaacatattttctgtaatatactcatagaatatgtgattataagtaaataaatagatgttggggtagtcctccagattggttgtattacattttatttttttcaaaattcttttaattttaaaatttcttatttattacattt

SEQ ID NO: 355318 - DNA, 4686 bp, Homo sapiens
  misc_feature (1846)..(1846): n is a, c, g, or t
  misc_feature (2384)..(2384): n is a, c, g, or t
  misc_feature (2387)..(2387): n is a, c, g, or t
  misc_feature (2467)..(2467): n is a, c, g, or t
agccggagagacgcagcggcggccccagtgccgcccccgggcgcgtgagtggagccgggctcctttcccctaccgcgccgcgacccccgcccgggctgcgcgcgccgcctcccgcgagcccccggcccgactcccgggctcccgcgggtgggggccagggctggtcggcgccggcggggctcgcggcggcggcgggttgcgtcccccgcgcctgctggcccacgtggacctggccgtcgcttgccgtgcggcgcctttgcgaaaactcgacggaagtggcagggaccgggcattacctgcgagtgccgggcgcctcctgctccgctgtgcgcgcttggggtgggactcggcgggggaggggtcgtgtacattgtcccaccaggcgcaatgtagccgggcggcgcagaggatttcttttttggtcttgagagcatagagtcccttttcatattcacgtgtactcttaagaaagcgtctgttctccaaactggctttccattctccccgtcctaaatggtgcgtggctgacaccgtagtgttttcaaaactggatatggccaggatgctatagcattgtcagtgcatctccttggaaacaatgccatctttgaatgtgagagataaacctagtttcagcatgtctgcagcagagaccagtacatcaggcttattcccacaggaagcctcctaaagcctgtggcgcggcaaccatttccaggactaaataataatgtgtcagatgcctgtgagtggactgcctggccaaatgactcatgaagatattcacggaagaatagtcaaaaaccaaagaaaaggcatattctagaagcaccttcaattccatcgaggatttttgagcagctgaagaagaaagttctgaaaatatgagtgacaggactccagcacattttttttagttgtttcttacattatctttgttaacccatccgcttttgtgtataatattaagttattttccactactgcaatggctagtaatttacttaggctcagagttttactctgtatggacagagaaataggaggtaacaacagtgggagaacaaataggaacagttcactgggatgttggtccccagaaattggctttcattgaataattcctaaagggtgtcgtgtgctgaattgctttttcatagtgatgtgctgcttcttgttcatactcttatgactttaatttcacctttatctactcccagcctctgtatatgcctacgtttttaaaaataatttttggcactgaagatctgattaccatattttttcagtttaaaaattaaatcctcgcaaatagacctttggtatagttgcattctaccctaggttattttctaggatcaagaatagaacaatttctgttctttccagcattactctttactattcatatgttcttgttcagtgttttgttgttctcatattctaggtggaaatgaagggtaatctctatgttctattttcagttttctaggaaaccagaaaaacatgggtagtagaaatgtatagaaaatgtatgaggtctcttaaccattgtgttaaacttgcattaagcttcttttttagcaatatcgatgtcagtgttacctcttctttcctttttatttattttttttgagacagagtctcattctgtcgcccagactggttggagtgcgatgatgcgatcgcggctaactgcaaccgctgcctcccgggtacaagtgattctcgtgccttgggctcccgagtagctgggatttttagtggagaacaggtttcaccatattggccaggctggtcttgaactcgcaacctcaggtgatccacccacctcagcctccccaangtgttgggattacaggcatgagccaccatacctggccccttttgttgttttgaggggcaggcagtaagaagcagggatttcttcaaatgctagtaagcacaaagagagggagaagtttttgtaagtaacgaacagggccgggcatggtggcgtgagaggccgaggtgggcagatcacgaggtcaggagttcgagaccagcctgaccaacatggtgaaacccccgtctccactagaaatgcaaagattagccgggcatggtggtgcacgcctgtaatccagctagtcgggaggctgaggcaggagaatcgcttgaacctgggaggtggaggttgcagggagctgagatcacgccactgcactccagcctgggcgacagagtaagactcccgtctcaaaaaaaaaaaaaaaaaaaaaagaacagttgatcattaaggccattaatgtgcatggacagtttgttgcccaggttggagtgtgatgacgacgcaatctcggtaaatataaacctactctgtaacctccacctcctgggctcangcngttctcgtgcttcagcctcccgagtagctgggatcacaggcatgcgccactaagcccagctaatttttgtatttttagtngagacggggtttcaccatgttggccaggctggtcttgaactcctggcctcaagtgatgcgcctgcctgggcctcccaaagtgctgggattacaggtgtgagccactgcacctggcccaataggcacatttttttaataagtagtttgttgattagaacgaagagcacttgccgtaagtgcatgtcattgttttcagctgttatggctaagtcagttaacctcatcaacaattttttcttctgtaaattgaggacaatttttgcttttatgaatgaagtcttaaccagcaggaagaaatataaacaaaggaacatatttttaatttaatgaagcaaaattccatacatcattttgaaaatagtgtttctttccctgataggcctgttctgcatcattcttttagcttccttctgccctgtttatcacttggtcccacttttatatttttcctcttcggtccagaatttcttatttagtttcttgtattttgcctactccctcccttctccatgattcagcctagtctttccgtcctctgtggacttgggtgtgccttcctctgggccacctcgtcttttgctgctgttagccctcccgcctgcgcacctgccacttcaccctcgcctgtggtccacttacgttccactcagcccggtcagtcctgctttgttcttctccaccgccttggtctcccgtgtgtcttatctagctctggttccttctcgtctccacatttattttgttttcttcctgtgcttgttagtccttgtgcacttggtccttgagctctttttctattaataggtattactagatggatttgttgtctgcctttacatagaacacacatccttactgtgcatttcctgggtagccaggatgaatcaattattattaacttcccttcgaacattgagcttcctctgttttctgtttctaagaattagattagtattctagaagactaatactactttaaagacagtcaaaacagtcatacgctgccatttcagccctttatttaagagtttgtgacatttatcactcccttgaaagattaaagaacacccaaagcaagtttggggtggaggtggggaaggcaggaagagaaaggtaagtgctataaaaggactcattgttaatttctagaaattggactgagatctgaaagcataagccttaacattttttagataaacggtccctgaaaagaataaaaagtatcagtacttccgttaactagctttagtattgggtcatttgtagtttacattctcctttaagttttaagaccttcagtagttaacaaagcagacagagactggccaggcacagtggctcacacctgtaataccagcactttgggaggctgagttgggtggatcacaaggtcaggagattgaaaccatcctggccaacatggtgaaaccccgtctctactaaaaatacaaaaaaaaaaaaaaattagccaggcgtggtggcaggcacctgtggtcccagctactcgggaggctggggcaggagaatttcttgagcccgggaggccgaggttgcagtgagctgagatcgcgccactgcactccagcctgggtgacagcgagactctgtctcaaaaagaaaaaaaaaaaaaaaagcagagacttaatcttgtaaatactcattttatttttgagaggcttaatgtctccttaaatattaacctgtgtcattttgtaattatactgtaatagtgtcagaatgccattaacaaccaacccttttcgtttcttgtgtgggaaagctcataaattgtgtggtcttacccctctggaccctgtagttgtagcattgtgaaaatggagcttttggcaaaactttgtattatgctgttgactcacattgtctcatatttttcctttattcttctatattctatgaatatggtgctgtcctgtcatttaattattataatatatgtgaactgctggaggtagactgatgtgagtgcagtttttcaacttaaaaacccttatatatcacattcatggtgtttaagatataagaacagccctacaaagaggggttgattgtattgaagattctttctgctgagcctgccttaattgtgagggtggttgtttgggtatcttagagctaaaagaatgccaagcagtcgtcgcaaccggacggggagcacgccaagccgggaccacagcctgcaggtgtggttgtctgtcatg

SEQ ID NO: 355319 - DNA, 4445 bp, Homo sapiens
agccggagagacgcagcggcggccccagtgccgcccccgggcgcgtgagtggagccgggctcctttcccctaccgcgccgcgacccccgcccgggctgcgcgcgccgcctcccgcgagcccccggcccgactcccgggctcccgcgggtgggggccagggctggtcggcgccggcggggctcgcggcggcggcgggttgcgtcccccgcgcctgctggcccacgtggacctggccgtcgcttgccgtgcggcgcctttgcgaaaactcgacggaagtggcagggaccgggcattacctgcgagtgccgggcgcctcctgctccgctgtgcgcgcttggggtgggactcggcgggggaggggtcgtgtacattgtcccaccaggcgcaatgtagccgggcggcgcagaggatttcttttttggtcttgagagcatagagtcccttttcatattcacgtgtactcttaagaaagcgtctgttctccaaactggctttccattctccccgtcctaaatggtgcgtggctgacaccgtagtgttttcaaaactggatatggccaggatgctatagcattgtcagtgcatctccttggaaacaatgccatctttgaatgtgagagataaacctagtttcagcatgtctgcagcagagaccagtacatcaggcttattcccacaggaagcctcctaaagcctgtggcgcggcaaccatttccaggactaaataataatgtgtcagatgcctgtgagtggactgcctggccaaatgactcatgaagatattcacggaagaatagtcaaaaaccaaagaaaaggcatattctagaagcaccttcaattccatcgaggatttttgagcagctgaagaagaaagttctgaaaatatgagtgacaggactccagcacattttttttagttgtttcttacattatctttgttaacccatccgcttttgtgtataatattaagttattttccactactgcaatggctagtaatttacttaggctcagagttttactctgtatggacagagaaataggaggtaacaacagtgggagaacaaataggaacagttcactgggatgttggtccccagaaattggctttcattgaataattcctaaagggtgtcgtgtgctgaattgctttttcatagtgatgtgctgcttcttgttcatactcttatgactttaatttcacctttatctactcccagcctctgtatatgcctacgtttttaaaaataatttttggcactgaagatctgattaccatattttttcagtttaaaaattaaatcctcgcaaatagacctttggtatagttgcattctaccctaggttattttctaggatcaagaatagaacaatttctgttctttccagcattactctttactattcatatgttcttgttcagtgttttgttgttctcatattctaggtggaaatgaagggtaatctctatgttctattttcagttttctaggaaaccagaaaaacatgggtagtagaaatgtatagaaaatgtatgaggtctcttaaccattgtgttaaacttgcattaagcttcttttttagcaatatcgatgtcagtgttacctcttctttcctttttatttattttttttgagacagagtctcattctgtcgcccagactggttggagtgcgatgatgcgatcgcggctaactgcaaccgctgcctcccgggtacaagtgattctcgtgccttgggctcccgagtagctgggatttttagtggaacatggtgaaaccccgtctctactaaaaatacaaaaaaaaaaaaaaattagccaggcgtggtggcaggcacctgtggtcccagctactcgggaggctggggcaggagaatttcttgagcccgggaggccgaggttgcagtgagctgagatcgcgccactgcactccagcctgggtgacagcgagactctgtctcaaaaagaaaaaaaaaaaaaaaagcagagacttaatcttgtaaatactcattttatttttgagaggcttaatgtctccttaaatattaacctgtgtcattttgtaattatactgtaatagtgtcagaatgccattaacaaccaacccttttcgtttcttgtgtgggaaagctcataaattgtgtggtcttacccctctggaccctgtagttgtagcattgtgaaaatggagcttttggcaaaactttgtattatgctgttgactcacattgtctcatatttttcctttattcttctatattctatgaatatggtgctgtcctgtcatttaattattataatatatgtgaactgctggaggtagactgatgtgagtgcagtttttcaacttaaaaacccttatatatcacattcatggtgtttaagatataagaacagccctacaaagaggggttgattgtattgaagattctttctgctgagcctgccttaattgtgagggtggttgtttgggtatcttagagctaaaagaatggctaagagtccattaatggtcctgtaatattcaccatccctgagcagttagtaaagaatggccgcaaagccacaattaggctactaacaaggaacttatgtagatgtgctaggtccagcctgtgttctggaactatagagatgaataaggtatggtcctttctctctggaggctcacagttgaatagggaatattaatacgtgaatgatagcagtacagtgtggcagatgctaaaatatatgtgtgtagcagctattacaggagaactgattaatagggagagtctggctgggctcagtgactcacccctgtaatcccagcactttgggaggccgaggcgggcagatcacttgaggtcaggagttcgagaccagcctggccaacatggtaaaacctcatctctactaaaaaatacaaagaaaattagcaaggcgtggtggcgggcatctgtaatcccagctactggggaggctgaagcaggagaatcccttgaacccgggaggtgaggttgcagtgagctgagatcatgccactgcactccagcctgggtgacagagtaagactgtctcaaaaacaaaacccaaaatactaaccatatttatagttagtcacctcaccctttttttagttaaaagaagtttatttagcctgatcagtttaccagatgtcttttttagtgacttttgtgtcttccataaatccattctcaaaatttgcaacagttgagcatatttgaccaaaatgtgccacaggtttctgaagcctgttcaagaagaagcatgtcaacattattggagtaggtcttcgcaatgactacttttgggaagatttgagtaaaatttatggatacagaagttttggagtatgttagaatattactaagtctttttatagttgtaatcccaacactgggttatatatatttaataccaacctgagtatatttcctgaataatatctgttttggagacttggacaaagttaacttttttgcttttttaaaagttgctgtttaaattaacttcctgcatttctaatgtagaaaaaatatggcacagtgatttgaattttgtttatggtttattatcttcctaaattatcagctctttaaaatatgggtctctggcctgtataccatctgataaattaggttgggtaaatttttcacctgaaaaaattcattcttttgacccaggttgtttggcttggaaaaaaaaaatcacatactcattgcatgattaaacttgtccatcagattgtgattttgtgcgttatgaggattgtagctggggtaattttaaaatgttggtatttggatagaactgccagcccaggattttgataaagatcaaaatatatactgtatctaaagtttcttttttaaaagttatttcacttataatcaaaaggtttaaataagtttagtgtatattttatgattagtattattttgtatcgattcagagagaggaaaactgcattcccatagacagggagacttggtgcattaatatccaaagcttagtttaagctggtgatgattagaaaagtggctttcatttgtgttctctggaagattctcagtagtcctgtgggcatgtgaacaagagcatgtgtaatcttcataatgtatgtcttgttagcagaaatgtctgaggcattgctgagatgtaggatgagctgaggtactggttttgtctttcatggttccctattatgttttttgagaaactgagcttttcctgacagtgtttagtttttcttggctatttactatgctattaatagtaacagtttccattatggagcctcagtaggttcttgacatacattaacccattgctattatgtaattttctaataaaatgatgtgataaaacatattttctgtaatatactcatagaatatgtgattataagtaaataaatagatgttggggtagtcctcca

SEQ ID NO: 355320 - DNA, 3127 bp, Homo sapiens
acgcggggccactcacgctgccggctccggaggcggcacgcggccagcgctgctccgctccggggctctttaccccggagtcggggccgggcgcgcgggaaacggttaccgagcggacctggacgccctctgccttcgtcatttcctgccggccggtcggtttccggatgaaacgaggagccaggaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatgttgccaactcctttggtacagccgtgggctctggtgtggtgaccttgaggcaggcatgcattttagcttcaatatttgaaaccaccggctccgtgttactaggcgccaaagtaggagaaaccattcgcaaaggtatcattgacgtgaacctgtacaacgagacggtggagactctcatggctggggaagttagtgccatggttggttccgctgtgtggcagctgattgcttccttcctgaggcttccaatctcaggaacgcactgcattgtgggttctactataggattctcactggtcgcaatcggtaccaaaggtgtgcagtggatggagcttgtcaagattgttgcttcttggtttatatctccactgttgtctggtttcatgtctggcctgctgtttgtactcatcagaattttcatcttaaaaaaggaagaccctgttcccaatggcctccgggcactcccagtattctatgctgctaccatagcaatcaatgtcttttccatcatgtacacaggagcaccagtgctcggccttgttctccccatgtgggccatagccctcatttcctttggtgtcgccctcctgttcgctttttttgtgtggctcttcgtgtgtccgtggatgcggaggaaaataacaggcaaattacaaaaagaaggtgctttatcacgagtatctgacgaaagcctcagtaaggttcaggaagcagagtccccagtatttaaagagctaccaggtgccaaggctaatgatgacagcaccatcccgctcacgggagcagcaggggagacactggggacctcggaaggcacttctgcgggcagccaccctcgggctgcatacggaagagcactgtccatgacccatggctctgtgaaatcgcccatctccaacggcaccttcggcttcgacggccacaccaggagcgacggtcatgtgtaccacaccgtgcacaaagactcggggctctacaaagatctgctgcacaaaatccacatcgacaggggccccgaggagaagccagcccaggaaagcaactaccggctgctgcgccgaaacaacagttacacctgctacaccgcagccatttgtgggctgccagtgcacgccacctttcgagctgcggactcatcggccccagaggacagtgagaagctggtgggcgacaccgtgtcctactccaagaagaggctgcgctacgacagctactcgagctactgtaacgcggtggcagaggcggagatcgaggcggaggagggcggcgtggagatgaagctggcgtcggagctggccgaccctgaccagccgcgagaggaccctgcagaggaggagaaggaggagaaggacgcacccgaggttcacctcctgttccatttcctgcaggtcctcaccgcctgtttcgggtcctttgctcacggcggcaatgacgtgagtaatgccatcggtcccctggtagccttgtggctgatttacaaacaaggcggggtaacgcaagaagcagctacacccgtctggctgctgttttatggaggagttggaatctgcacaggcctctgggtctgggggagaagagtgatccagaccatggggaaggacctcactcccatcacgccgtccagcggcttcacgatcgagctggcctcagccttcacagtggtgatcgcctccaacatcgggcttccagtcagcaccacgcactgtaaggtgggctcggtggtggccgtgggctggatccgctcccgcaaggctgtggactggcgcctctttcggaacatcttcgtggcctggttcgtgaccgtccctgtggctgggctgttcagcgctgctgtcatggctcttctcatgtatgggatccttccatatgtgtgatttgtcttcttccagctgcaaacagctaaagggatggtctggtgttggcgtgtgggagacatgtgtgctcgtgccgcacatacacatcctggccgtgcacggctctctcatgaccagctctctgcctcccttccaggaggctccatcccacactgttcacccaggctgcggagactcaccttcccgagctaacttaactactgtacataataatatgtattaaactggtatcgtggtgatataatgtggtgcagttacttatatattaaatatctattgtatccatagaataggcagcattatttcaaacatattcaagttgggagtggagatcattgcctagaagtcaatattcaataaatcttgtacataactatttcgatggcaaatgttaagccttctaaaaggaaagtgtagattggaaaatgattttttttccaaatgatgtttttgccttctaatatactgtaaggtaatgagcttcagaacaggcaacctgaccctgcagaggtcgcgtgctgtgggatgacagcgggacgggagctcacaagtgctttcactgaagatttgttcatatactgtgtattgattgttgtgtaatatatcatcattgcttttgtaaatacgtaaaactgtaattttttaatggtgtgcttctttggtactttccaaaattctctgatcaaaaaagtataagggaagcacaccattaaaaatacc

SEQ ID NO: 355321 - DNA, 3019 bp, Homo sapiens
acgcggggccactcacgctgccggctccggaggcggcacgcggccagcgctgctccgctccggggctctttaccccggagtcggggccgggcgcgcgggaaacggttaccgagcggacctggacgccctctgccttcgtcatttcctgccggccggtcggtttccggatgaaacgaggagccaggaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatgttgccaactcctttggtacagccgtgggctctggtgtggtgaccttgaggcaggcatgcattttagcttcaatatttgaaaccaccggctccgtgttactaggcgccaaagtaggagaaaccattcgcaaaggtatcattgacgtgaacctgtacaacgagacggtggagactctcatggctggggaagttagtgccatggttggttccgctgtgtggcagctgattgcttccttcctgaggcttccaatctcaggaacgcactgcattgtgggttctactataggattctcactggtcgcaatcggtaccaaaggtgtgcagtggatggagcttgtcaagattgttgcttcttggtttatatctccactgttgtctggtttcatgtctggcctgctgtttgtactcatcagaattttcatcttaaaaaaggaagaccctgttcccaatggcctccgggcactcccagtattctatgctgctaccatagcaatcaatgtcttttccatcatgtacacaggagcaccagtgctcggccttgttctccccatgtgggccatagccctcatttcctttggtgtcgccctcctgttcgctttttttgtgtggctcttcgtgtgtccgtggatgcggaggaaaataacaggcaaattacaaaaagaaggtgctttatcacgagtatctgacgaaagcctcagtaaggttcaggaagcagagtccccagtatttaaagagctaccaggtgccaaggctaatgatgacagcaccatcccgctcacgggagcagcaggggagacactggggacctcggaaggcacttctgcgggcagccaccctcgggctgcatacggaagagcactgtccatgacccatggctctgtgaaatcgcccatctccaacggcaccttcggcttcgacggccacaccaggagcgacggtcatgtgtaccacaccgtgcacaaagactcggggctctacaaagatctgctgcacaaaatccacatcgacaggggccccgaggagaagccagcccaggaaagcaactaccggctgctgcgccgaaacaacagttacacctgctacaccgcagccatttgtgggctgccagtgcacgccacctttcgagctgcggactcatcggccccagaggacagtgagaagctggtgggcgacaccgtgtcctactccaagaagaggctgcgctacgacagctactcgagctactgtaacgcggtggcagaggcggagatcgaggcggaggagggcggcgtggagatgaagctggcgtcggagctggccgaccctgaccagccgcgagaggaccctgcagaggaggagaaggaggagaaggacgcacccgaggttcacctcctgttccatttcctgcaggtcctcaccgcctgtttcgggtcctttgctcacggcggcaatgacgtgagtaatgccatcggtcccctggtagccttgtggctgatttacaaacaaggcggggtaacgcaagaagcagctacacccgtctggctgctgttttatggaggagttggaatctgcacaggcctctgggtctgggggagaagagtgatccagaccatggggaaggacctcactcccatcacgccgtccagcggcttcacgatcgagctggcctcagccttcacagtggtgatcgcctccaacatcgggcttccagtcagcaccacgcactgtaaggtgggctcggtggtggccgtgggctggatccgctcccgcaaggctgtggactggcgcctctttcggaacatcttcgtggcctggttcgtgaccgtccctgtggctgggctgttcagcgctgctgtcatggctcttctcatgtatgggatccttccatatgtgtgatttgtcttcttccagctgcaaacagctaaagggatggtctggtgttggcgtgtgggagacatgtgtgctcgtgccgcacatacacatcctggccgtgcacggctctctcatgaccagctctctgcctcccttccaggaggctccatcccacactgttcacccaggctgcggagactcaccttcccgagctaacttaactactgtacataataatatgtattaaactggtatcgtggtgatataatgtggtgcagttacttatatattaaatatctattgtatccatagaataggcagcattatttcaaacatattcaagttgggagtggagatcattgcctagaagtcaatattcaataaatcttgtacataactatttcgatggcaaatgttaagccttctaaaaggaaagtgtagattggaaaatgattttttttccaaatgatgtttttgccttctaatatactgtaaggtaatgagcttcagaacaggcaacctgaccctgcagaggtcgcgtgctgtgggatgacagcgggacgggagctcacaagtgctttcactgaagatttgttcatatactgtgtagaaagggaacgggatcctctagatcac

SEQ ID NO: 355322 - DNA, 1145 bp, Homo sapiens
agccggagagacgcagcggcggccccagtgccgcccccgggcgcgtgagtggagccgggctcctttcccctaccgcgccgcgacccccgcccgggctgcgcgcgccgcctcccgcgagcccccggcccgactcccgggctcccgcgggtgggggccagggctggtcggcgccggcggggctcgcggcggcggcgggttgcgtcccccgcgcctgctggcccacgtggacctggccgtcgcttgccgtgcggcgcctttgcgaaaactcgacggaagtggcagggaccgggcattacctgcgagtgccgggcgcctcctgctccgctgtgcgcgcttggggtgggactcggcgggggaggggtcgtgtacattgtcccaccaggcgcaatgtagccgggcggcgcagaggatttcttttttggtcttgagagcatagagtcccttttcatattcacgtgtactcttaagaaagcgtctgttctccaaactggctttccattctccccgtcctaaatggtgcgtggctgacaccgtagtgttttcaaaactggatatggccaggatgctatagcattgtcagtgcatctccttggaaacaatgccatctttgaatgtgagagataaacctagtttcagcatgtctgcagcagagaccagtacatcaggcttattcccacaggaagcctcctaaagcctgtggcgcggcaaccatttccaggactaaataataatgtgtcagatgcctgtgagtggactgcctggccaaatgactcatgaagatattcacggaagaatagtcaaaaaccaaagaaaaggcatattctagaagcaccttcaattccatcgaggatttttgagcagctgaagaagaaagttctgaaaatatgagtgacaggactccagcacattttttttagttgtttcttacattatctttgttaacccatccgcttttgtgtataatattaagttattttccactactgcaatggctagtaatttacttaggctcagagttttactctgtatggacagagaaattggcgtgaccccggggggaaccattcgggaccgttccggggatgtggcccctggcgcctggcccaaggggggggcgcggtcagaggcagggcggctcacccccc

SEQ ID NO: 355323 - DNA, 606 bp, Homo sapiens
tcagctcggtaccctctctccacactgggggggaggggtcgtgtacattgtcccaccaggcgcaatgtagccgggcggcgcagaggatttcttttttggtcttgagagcatagagtcccttttcatattcacgtgtactcttaagaaagcgtctgttctccaaactggctttccattctccccgtcctaaatggtgcgtggctgacaccgtagtgttttcaaaactggatatggccaggatgctatagcattgtcagtgtaagtcccttttgggtatttttatttaattgtgtagtgacttgacagaagtgtttcccagcttgacctaagtaatgaatttgcataggatttcagcatcagtatggaagtgatcagatgtcagtggctggtgccaccttgcagataaatggccactggtccacgtagttcgtctttactatacattttgattaagttctctaggaccagctgactggtaattataagtcacatgaaaccctgcagagatgagagcttacattgaacacttcttaacaagttttctattctttgtttcatctgttacaattaaactcaccttcgtctagggtaagaccattactttac

SEQ ID NO: 355324 - DNA, 248 bp, Homo sapiens
ataaagagctatatgctgaagagaagaatccccaaacaattctacctaaaatctaagctattttaaaagctttaacaaatgtaggggactgggtaatgttgtactagagcttgtttctgagattagcccatgtacattggtagagtgtagcctttgtggctcacctgtttttactttgcaatgtctgctcccacaggtgggctcggtggtggccgtgggctggatccgctcccgcaaggctgtggact

SEQ ID NO: 355325 - DNA, 3735 bp, Homo sapiens
acgcggggccactcacgctgccggctccggaggcggcacgcggccagcgctgctccgctccggggctctttaccccggagtcggggccgggcgcgcgggaaacggttaccgagcggacctggacgccctctgccttcgtcatttcctgccggccggtcggtttccggatgaaacgaggagccaggaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatgttgccaactcctttggtacagccgtgggctctggtgtggtgaccttgaggcaggcatgcattttagcttcaatatttgaaaccaccggctccgtgttactaggcgccaaagtaggagaaaccattcgcaaaggtatcattgacgtgaacctgtacaacgagacggtggagactctcatggctggggaagttagtgccatggttggttccgctgtgtggcagctgattgcttccttcctgaggcttccaatctcaggaacgcactgcattgtgggttctactataggattctcactggtcgcaatcggtaccaaaggtgtgcagtggatggagcttgtcaagattgttgcttcttggtttatatctccactgttgtctggtttcatgtctggcctgctgtttgtactcatcagaattttcatcttaaaaaaggaagaccctgttcccaatggcctccgggcactcccagtattctatgctgctaccatagcaatcaatgtcttttccatcatgtacacaggagcaccagtgctcggccttgttctccccatgtgggccatagccctcatttcctttggtgtcgccctcctgttcgctttttttgtgtggctcttcgtgtgtccgtggatgcggaggaaaataacaggcaaattacaaaaagaaggtgctttatcacgagtatctgacgaaagcctcagtaaggttcaggaagcagagtccccagtatttaaagagctaccaggtgccaaggctaatgatgacagcaccatcccgctcacgggagcagcaggggagacactggggacctcggaaggcacttctgcgggcagccaccctcgggctgcatacggaagagcactgtccatgacccatggctctgtgaaatcgcccatctccaacggcaccttcggcttcgacggccacaccaggagcgacggtcatgtgtaccacaccgtgcacaaagactcggggctctacaaagatctgctgcacaaaatccacatcgacaggggccccgaggagaagccagcccaggaaagcaactaccggctgctgcgccgaaacaacagttacacctgctacaccgcagccatttgtgggctgccagtgcacgccacctttcgagctgcggactcatcggccccagaggacagtgagaagctggtgggcgacaccgtgtcctactccaagaagaggctgcgctacgacagctactcgagctactgtaacgcggtggcagaggcggagatcgaggcggaggagggcggcgtggagatgaagctggcgtcggagctggccgaccctgaccagccgcgagaggaccctgcagaggaggagaaggaggagaaggacgcacccgaggttcacctcctgttccatttcctgcaggtcctcaccgcctgtttcgggtcctttgctcacggcggcaatgacgtgagtaatgccatcggtcccctggtagccttgtggctgatttacaaacaaggcggggtaacgcaagaagcagctacacccgtctggctgctgttttatggaggagttggaatctgcacaggcctctgggtctgggggagaagagtgatccagaccatggggaaggacctcactcccatcacgccgtccagcggcttcacgatcgagctggcctcagccttcacagtggtgatcgcctccaacatcgggcttccagtcagcaccacgcactgtaaggtgggctcggtggtggccgtgggctggatccgctcccgcaaggctgtggactggcgcctctttcggaacatcttcgtggcctggttcgtgaccgtccctgtggctgggctgttcagcgctgctgtcatggctcttctcatgtatgggatccttccatatgtgtgatttgtcttcttccagctgcaaacagctaaagggatggtctggtgttggcgtgtgggagacatgtgtgctcgtgccgcacatacacatcctggccgtgcacggctctctcatgaccagctctctgcctcccttccaggaggctccatcccacactgttcacccaggctgcggagactcaccttcccgagctaacttaactactgtacataataatatgtattaaactggtatcgtggtgatataatgtggtgcagttacttatatattaaatatctattgtatccatagaataggcagcattatttcaaacatattcaagttgggagtggagatcattgcctagaagtcaatattcaataaatcttgtacataactatttcgatggcaaatgttaagccttctaaaaggaaagtgtagattggaaaatgattttttttccaaatgatgtttttgccttctaatatactgtaaggtaatgagcttcagaacaggcaacctgaccctgcagaggtcgcgtgctgtgggatgacagcgggacgggagctcacaagtgctttcactgaagatttgttcatatactgtgtattgattgttgtgtaatatatcatcattgcttttgtaaatacgtaaaactgtaattttttaatggtgtgcttcccttatacttttttgatcagagaattttggaaagtaccaaagaagcaggggaatcattggccagtgttacgttttcacattgtctgtctcccaccctcactgatcacgcctgccccagagcagtgtgtggcggtgacaccgtcacccagcatgcgccacgccgtggctcccaccagcagtgccaccgccaccacaccccagatcccacccaccttgcagtggcctttccttgtcatcagagtagagaatgcacaggtgttggtgagggcgtgtggctgagcactacatgtcaagtccagagtcagtttctatcccaattctccctgcagcctgaagaacggatccttgtctccaatgtcagcacaaaggaggctttttctgtgctttgacattctagcacttcagggatgagagggagggagaatcctggatgctggatggagtatttctctgaggcccacacaaagctggacacccccaggctctactccatcccattggagtctcttctttttttgatagcgggagggaggaagtacgactaatgttggagcctgaaactatggaaatgctgctaaaatttttatattgacaaacattttcttggtacttcattgtcatttttcattaatcaaccatattaaatttataataaaaaatgcccctcagaa

SEQ ID NO: 355326 - DNA, 4188 bp, Homo sapiens
  misc_feature (3746)..(3746): n is a, c, g, or t
  misc_feature (3800)..(3800): n is a, c, g, or t
acgcggggccactcacgctgccggctccggaggcggcacgcggccagcgctgctccgctccggggctctttaccccggagtcggggccgggcgcgcgggaaacggttaccgagcggacctggacgccctctgccttcgtcatttcctgccggccggtcggtttccggatgaaacgaggagccaggaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatgttgccaactcctttggtacagccgtgggctctggtgtggtgaccttgaggcaggcatgcattttagcttcaatatttgaaaccaccggctccgtgttactaggcgccaaagtaggagaaaccattcgcaaaggtatcattgacgtgaacctgtacaacgagacggtggagactctcatggctggggaagttagtgccatggttggttccgctgtgtggcagctgattgcttccttcctgaggcttccaatctcaggaacgcactgcattgtgggttctactataggattctcactggtcgcaatcggtaccaaaggtgtgcagtggatggagcttgtcaagattgttgcttcttggtttatatctccactgttgtctggtttcatgtctggcctgctgtttgtactcatcagaattttcatcttaaaaaaggaagaccctgttcccaatggcctccgggcactcccagtattctatgctgctaccatagcaatcaatgtcttttccatcatgtacacaggagcaccagtgctcggccttgttctccccatgtgggccatagccctcatttcctttggtgtcgccctcctgttcgctttttttgtgtggctcttcgtgtgtccgtggatgcggaggaaaataacaggcaaattacaaaaagaaggtgctttatcacgagtatctgacgaaagcctcagtaaggttcaggaagcagagtccccagtatttaaagagctaccaggtgccaaggctaatgatgacagcaccatcccgctcacgggagcagcaggggagacactggggacctcggaaggcacttctgcgggcagccaccctcgggctgcatacggaagagcactgtccatgacccatggctctgtgaaatcgcccatctccaacggcaccttcggcttcgacggccacaccaggagcgacggtcatgtgtaccacaccgtgcacaaagactcggggctctacaaagatctgctgcacaaaatccacatcgacaggggccccgaggagaagccagcccaggaaagcaactaccggctgctgcgccgaaacaacagttacacctgctacaccgcagccatttgtgggctgccagtgcacgccacctttcgagctgcggactcatcggccccagaggacagtgagaagctggtgggcgacaccgtgtcctactccaagaagaggctgcgctacgacagctactcgagctactgtaacgcggtggcagaggcggagatcgaggcggaggagggcggcgtggagatgaagctggcgtcggagctggccgaccctgaccagccgcgagaggaccctgcagaggaggagaaggaggagaaggacgcacccgaggttcacctcctgttccatttcctgcaggtcctcaccgcctgtttcgggtcctttgctcacggcggcaatgacgtgagtaatgccatcggtcccctggtagccttgtggctgatttacaaacaaggcggggtaacgcaagaagcagctacacccgtctggctgctgttttatggaggagttggaatctgcacaggcctctgggtctgggggagaagagtgatccagaccatggggaaggacctcactcccatcacgccgtccagcggcttcacgatcgagctggcctcagccttcacagtggtgatcgcctccaacatcgggcttccagtcagcaccacgcactgtaaggtgggctcggtggtggccgtgggctggatccgctcccgcaaggctgtggactggcgcctctttcggaacatcttcgtggcctggttcgtgaccgtccctgtggctgggctgttcagcgctgctgtcatggctcttctcatgtatgggatccttccatatgtgtgatttgtcttcttccagctgcaaacagctaaagggatggtctggtgttggcgtgtgggagacatgtgtgctcgtgccgcacatacacatcctggccgtgcacggctctctcatgaccagctctctgcctcccttccaggaggctccatcccacactgttcacccaggctgcggagactcaccttcccgagctaacttaactactgtacataataatatgtattaaactggtatcgtggtgatataatgtggtgcagttacttatatattaaatatctattgtatccatagaataggcagcattatttcaaacatattcaagttgggagtggagatcattgcctagaagtcaatattcaataaatcttgtacataactatttcgatggcaaatgttaagccttctaaaaggaaagtgtagattggaaaatgattttttttccaaatgatgtttttgccttctaatatactgtaaggtaatgagcttcagaacaggcaacctgaccctgcagaggtcgcgtgctgtgggatgacagcgggacgggagctcacaagtgctttcactgaagatttgttcatatactgtgtattgattgttgtgtaatatatcatcattgcttttgtaaatacgtaaaactgtaattttttaatggtgtgcttcccttatacttttttgatcagagaattttggaaagtaccaaagaagcaggggaatcattggccagtgttacgttttcacattgtctgtctcccaccctcactgatcacgcctgccccagagcagtgtgtggcggtgacaccgtcacccagcatgcgccacgccgtggctcccaccagcagtgccaccgccaccacaccccagatcccacccaccttgcagtggcctttccttgtcatcagagtagagaatgcacaggtgttggtgagggcgtgtggctgagcactacatgtcaagtccagagtcagtttctatcccaattctccctgcagcctgaagaacggatccttgtctccaatgtcagcacaaaggaggctttttctgtgctttgacattctagcacttcagggatgagagggagggagaatcctggatgctggatggagtatttctctgaggcccacacaaagctggacacccccaggctctactccatcccattggagtctcttctttttttgatagcgggagggaggaagtacgactaatgttggagcctgaaactatggaaatgctgctaaaatttttatattgacaaacattttcttggtacttcattgtcatttttcattaatcaaccatattaaatttataataaaaaatgcccctcagaaaaataataaanaaaaaaaaaaaaaaaaaaaaagcacaaaaaaaaaaaaaaaaaaaaaaaaaaaanaaaaaaaaaagacaagggggcggcgcgcgcgccgcgacaaatgatcctccgccacgggggaggacaactcatcggcagcccccacccaatattctttagaaaaaggggcgccgccacgaaaaagaggaggatggcattatatcaaaacagcagcgaggcggaccgcggcagcgcccgcaacacaacaggatgcaggtggcgcggggcgggacacataggctgctgctcggaggcgaatcctctgagtgggcgggagggcccctttttcttgtgggggggggggacgtaacatctactgtgggcacgcttcatcatccccatagaaatgtaattatacgcctgcagttgagtgtggattatcaacaacttgcttgtgttgctagtttgc

SEQ ID NO: 355327 - DNA, 3870 bp, Homo sapiens
acgcggggccactcacgctgccggctccggaggcggcacgcggccagcgctgctccgctccggggctctttaccccggagtcggggccgggcgcgcgggaaacggttaccgagcggacctggacgccctctgccttcgtcatttcctgccggccggtcggtttccggatgaaacgaggagccaggaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatgttgccaactcctttggtacagccgtgggctctggtgtggtgaccttgaggcaggcatgcattttagcttcaatatttgaaaccaccggctccgtgttactaggcgccaaagtaggagaaaccattcgcaaaggtatcattgacgtgaacctgtacaacgagacggtggagactctcatggctggggaagttagtgccatggttggtagagatgacgacacaacagacagctgatgtatacgggtaatttggttagggagaagagggttagagaggaattctaccaccttctgctttcaacaggacatatcctcttgtaggaagagtcctgcagcaggaggttccgctgtgtggcagctgattgcttccttcctgaggcttccaatctcaggaacgcactgcattgtgggttctactataggattctcactggtcgcaatcggtaccaaaggtgtgcagtggatggagcttgtcaagattgttgcttcttggtttatatctccactgttgtctggtttcatgtctggcctgctgtttgtactcatcagaattttcatcttaaaaaaggaagaccctgttcccaatggcctccgggcactcccagtattctatgctgctaccatagcaatcaatgtcttttccatcatgtacacaggagcaccagtgctcggccttgttctccccatgtgggccatagccctcatttcctttggtgtcgccctcctgttcgctttttttgtgtggctcttcgtgtgtccgtggatgcggaggaaaataacaggcaaattacaaaaagaaggtgctttatcacgagtatctgacgaaagcctcagtaaggttcaggaagcagagtccccagtatttaaagagctaccaggtgccaaggctaatgatgacagcaccatcccgctcacgggagcagcaggggagacactggggacctcggaaggcacttctgcgggcagccaccctcgggctgcatacggaagagcactgtccatgacccatggctctgtgaaatcgcccatctccaacggcaccttcggcttcgacggccacaccaggagcgacggtcatgtgtaccacaccgtgcacaaagactcggggctctacaaagatctgctgcacaaaatccacatcgacaggggccccgaggagaagccagcccaggaaagcaactaccggctgctgcgccgaaacaacagttacacctgctacaccgcagccatttgtgggctgccagtgcacgccacctttcgagctgcggactcatcggccccagaggacagtgagaagctggtgggcgacaccgtgtcctactccaagaagaggctgcgctacgacagctactcgagctactgtaacgcggtggcagaggcggagatcgaggcggaggagggcggcgtggagatgaagctggcgtcggagctggccgaccctgaccagccgcgagaggaccctgcagaggaggagaaggaggagaaggacgcacccgaggttcacctcctgttccatttcctgcaggtcctcaccgcctgtttcgggtcctttgctcacggcggcaatgacgtgagtaatgccatcggtcccctggtagccttgtggctgatttacaaacaaggcggggtaacgcaagaagcagctacacccgtctggctgctgttttatggaggagttggaatctgcacaggcctctgggtctgggggagaagagtgatccagaccatggggaaggacctcactcccatcacgccgtccagcggcttcacgatcgagctggcctcagccttcacagtggtgatcgcctccaacatcgggcttccagtcagcaccacgcactgtaaggtgggctcggtggtggccgtgggctggatccgctcccgcaaggctgtggactggcgcctctttcggaacatcttcgtggcctggttcgtgaccgtccctgtggctgggctgttcagcgctgctgtcatggctcttctcatgtatgggatccttccatatgtgtgatttgtcttcttccagctgcaaacagctaaagggatggtctggtgttggcgtgtgggagacatgtgtgctcgtgccgcacatacacatcctggccgtgcacggctctctcatgaccagctctctgcctcccttccaggaggctccatcccacactgttcacccaggctgcggagactcaccttcccgagctaacttaactactgtacataataatatgtattaaactggtatcgtggtgatataatgtggtgcagttacttatatattaaatatctattgtatccatagaataggcagcattatttcaaacatattcaagttgggagtggagatcattgcctagaagtcaatattcaataaatcttgtacataactatttcgatggcaaatgttaagccttctaaaaggaaagtgtagattggaaaatgattttttttccaaatgatgtttttgccttctaatatactgtaaggtaatgagcttcagaacaggcaacctgaccctgcagaggtcgcgtgctgtgggatgacagcgggacgggagctcacaagtgctttcactgaagatttgttcatatactgtgtattgattgttgtgtaatatatcatcattgcttttgtaaatacgtaaaactgtaattttttaatggtgtgcttcccttatacttttttgatcagagaattttggaaagtaccaaagaagcaggggaatcattggccagtgttacgttttcacattgtctgtctcccaccctcactgatcacgcctgccccagagcagtgtgtggcggtgacaccgtcacccagcatgcgccacgccgtggctcccaccagcagtgccaccgccaccacaccccagatcccacccaccttgcagtggcctttccttgtcatcagagtagagaatgcacaggtgttggtgagggcgtgtggctgagcactacatgtcaagtccagagtcagtttctatcccaattctccctgcagcctgaagaacggatccttgtctccaatgtcagcacaaaggaggctttttctgtgctttgacattctagcacttcagggatgagagggagggagaatcctggatgctggatggagtatttctctgaggcccacacaaagctggacacccccaggctctactccatcccattggagtctcttctttttttgatagcgggagggaggaagtacgactaatgttggagcctgaaactatggaaatgctgctaaaatttttatattgacaaacattttcttggtacttcattgtcatttttcattaatcaaccatattaaatttataataaaaaatgcccctcagaa

SEQ ID NO: 355328 - DNA, 6561 bp, Homo sapiens
  misc_feature (1846)..(1846): n is a, c, g, or t
  misc_feature (2384)..(2384): n is a, c, g, or t
  misc_feature (2387)..(2387): n is a, c, g, or t
  misc_feature (2467)..(2467): n is a, c, g, or t
agccggagagacgcagcggcggccccagtgccgcccccgggcgcgtgagtggagccgggctcctttcccctaccgcgccgcgacccccgcccgggctgcgcgcgccgcctcccgcgagcccccggcccgactcccgggctcccgcgggtgggggccagggctggtcggcgccggcggggctcgcggcggcggcgggttgcgtcccccgcgcctgctggcccacgtggacctggccgtcgcttgccgtgcggcgcctttgcgaaaactcgacggaagtggcagggaccgggcattacctgcgagtgccgggcgcctcctgctccgctgtgcgcgcttggggtgggactcggcgggggaggggtcgtgtacattgtcccaccaggcgcaatgtagccgggcggcgcagaggatttcttttttggtcttgagagcatagagtcccttttcatattcacgtgtactcttaagaaagcgtctgttctccaaactggctttccattctccccgtcctaaatggtgcgtggctgacaccgtagtgttttcaaaactggatatggccaggatgctatagcattgtcagtgcatctccttggaaacaatgccatctttgaatgtgagagataaacctagtttcagcatgtctgcagcagagaccagtacatcaggcttattcccacaggaagcctcctaaagcctgtggcgcggcaaccatttccaggactaaataataatgtgtcagatgcctgtgagtggactgcctggccaaatgactcatgaagatattcacggaagaatagtcaaaaaccaaagaaaaggcatattctagaagcaccttcaattccatcgaggatttttgagcagctgaagaagaaagttctgaaaatatgagtgacaggactccagcacattttttttagttgtttcttacattatctttgttaacccatccgcttttgtgtataatattaagttattttccactactgcaatggctagtaatttacttaggctcagagttttactctgtatggacagagaaataggaggtaacaacagtgggagaacaaataggaacagttcactgggatgttggtccccagaaattggctttcattgaataattcctaaagggtgtcgtgtgctgaattgctttttcatagtgatgtgctgcttcttgttcatactcttatgactttaatttcacctttatctactcccagcctctgtatatgcctacgtttttaaaaataatttttggcactgaagatctgattaccatattttttcagtttaaaaattaaatcctcgcaaatagacctttggtatagttgcattctaccctaggttattttctaggatcaagaatagaacaatttctgttctttccagcattactctttactattcatatgttcttgttcagtgttttgttgttctcatattctaggtggaaatgaagggtaatctctatgttctattttcagttttctaggaaaccagaaaaacatgggtagtagaaatgtatagaaaatgtatgaggtctcttaaccattgtgttaaacttgcattaagcttcttttttagcaatatcgatgtcagtgttacctcttctttcctttttatttattttttttgagacagagtctcattctgtcgcccagactggttggagtgcgatgatgcgatcgcggctaactgcaaccgctgcctcccgggtacaagtgattctcgtgccttgggctcccgagtagctgggatttttagtggagaacaggtttcaccatattggccaggctggtcttgaactcgcaacctcaggtgatccacccacctcagcctccccaangtgttgggattacaggcatgagccaccatacctggccccttttgttgttttgaggggcaggcagtaagaagcagggatttcttcaaatgctagtaagcacaaagagagggagaagtttttgtaagtaacgaacagggccgggcatggtggcgtgagaggccgaggtgggcagatcacgaggtcaggagttcgagaccagcctgaccaacatggtgaaacccccgtctccactagaaatgcaaagattagccgggcatggtggtgcacgcctgtaatccagctagtcgggaggctgaggcaggagaatcgcttgaacctgggaggtggaggttgcagggagctgagatcacgccactgcactccagcctgggcgacagagtaagactcccgtctcaaaaaaaaaaaaaaaaaaaaaagaacagttgatcattaaggccattaatgtgcatggacagtttgttgcccaggttggagtgtgatgacgacgcaatctcggtaaatataaacctactctgtaacctccacctcctgggctcangcngttctcgtgcttcagcctcccgagtagctgggatcacaggcatgcgccactaagcccagctaatttttgtatttttagtngagacggggtttcaccatgttggccaggctggtcttgaactcctggcctcaagtgatgcgcctgcctgggcctcccaaagtgctgggattacaggtgtgagccactgcacctggcccaataggcacatttttttaataagtagtttgttgattagaacgaagagcacttgccgtaagtgcatgtcattgttttcagctgttatggctaagtcagttaacctcatcaacaattttttcttctgtaaattgaggacaatttttgcttttatgaatgaagtcttaaccagcaggaagaaatataaacaaaggaacatatttttaatttaatgaagcaaaattccatacatcattttgaaaatagtgtttctttccctgataggcctgttctgcatcattcttttagcttccttctgccctgtttatcacttggtcccacttttatatttttcctcttcggtccagaatttcttatttagtttcttgtattttgcctactccctcccttctccatgattcagcctagtctttccgtcctctgtggacttgggtgtgccttcctctgggccacctcgtcttttgctgctgttagccctcccgcctgcgcacctgccacttcaccctcgcctgtggtccacttacgttccactcagcccggtcagtcctgctttgttcttctccaccgccttggtctcccgtgtgtcttatctagctctggttccttctcgtctccacatttattttgttttcttcctgtgcttgttagtccttgtgcacttggtccttgagctctttttctattaataggtattactagatggatttgttgtctgcctttacatagaacacacatccttactgtgcatttcctgggtagccaggatgaatcaattattattaacttcccttcgaacattgagcttcctctgttttctgtttctaagaattagattagtattctagaagactaatactactttaaagacagtcaaaacagtcatacgctgccatttcagccctttatttaagagtttgtgacatttatcactcccttgaaagattaaagaacacccaaagcaagtttggggtggaggtggggaaggcaggaagagaaaggtaagtgctataaaaggactcattgttaatttctagaaattggactgagatctgaaagcataagccttaacattttttagataaacggtccctgaaaagaataaaaagtatcagtacttccgttaactagctttagtattgggtcatttgtagtttacattctcctttaagttttaagaccttcagtagttaacaaagcagacagagactggccaggcacagtggctcacacctgtaataccagcactttgggaggctgagttgggtggatcacaaggtcaggagattgaaaccatcctggccaacatggtgaaaccccgtctctactaaaaatacaaaaaaaaaaaaaaattagccaggcgtggtggcaggcacctgtggtcccagctactcgggaggctggggcaggagaatttcttgagcccgggaggccgaggttgcagtgagctgagatcgcgccactgcactccagcctgggtgacagcgagactctgtctcaaaaagaaaaaaaaaaaaaaaagcagagacttaatcttgtaaatactcattttatttttgagaggcttaatgtctccttaaatattaacctgtgtcattttgtaattatactgtaatagtgtcagaatgccattaacaaccaacccttttcgtttcttgtgtgggaaagctcataaattgtgtggtcttacccctctggaccctgtagttgtagcattgtgaaaatggagcttttggcaaaactttgtattatgctgttgactcacattgtctcatatttttcctttattcttctatattctatgaatatggtgctgtcctgtcatttaattattataatatatgtgaactgctggaggtagactgatgtgagtgcagtttttcaacttaaaaacccttatatatcacattcatggtgtttaagatataagaacagccctacaaagaggggttgattgtattgaagattctttctgctgagcctgccttaattgtgagggtggttgtttgggtatcttagagctaaaagaatggctaagagtccattaatggtcctgtaatattcaccatccctgagcagttagtaaagaatggccgcaaagccacaattaggctactaacaaggaacttatgtagatgtgctaggtccagcctgtgttctggaactatagagatgaataaggtatggtcctttctctctggaggctcacagttgaatagggaatattaatacgtgaatgatagcagtacagtgtggcagatgctaaaatatatgtgtgtagcagctattacaggagaactgattaatagggagagtctggctgggctcagtgactcacccctgtaatcccagcactttgggaggccgaggcgggcagatcacttgaggtcaggagttcgagaccagcctggccaacatggtaaaacctcatctctactaaaaaatacaaagaaaattagcaaggcgtggtggcgggcatctgtaatcccagctactggggaggctgaagcaggagaatcccttgaacccgggaggtgaggttgcagtgagctgagatcatgccactgcactccagcctgggtgacagagtaagactgtctcaaaaacaaaacccaaaatactaaccatatttatagttagtcacctcaccctttttttagttaaaagaagtttatttagcctgatcagtttaccagatgtcttttttagtgacttttgtgtcttccataaatccattctcaaaatttgcaacagttgagcatatttgaccaaaatgtgccacaggtttctgaagcctgttcaagaagaagcatgtcaacattattggagtaggtcttcgcaatgactacttttgggaagatttgagtaaaatttatggatacagaagttttggagtatgttagaatattactaagtctttttatagttgtaatcccaacactgggttatatatatttaataccaacctgagtatatttcctgaataatatctgttttggagacttggacaaagttaacttttttgcttttttaaaagttgctgtttaaattaacttcctgcatttctaatgtagaaaaaatatggcacagtgatttgaattttgtttatggtttattatcttcctaaattatcagctctttaaaatatgggtctctggcctgtataccatctgataaattaggttgggtaaatttttcacctgaaaaaattcattcttttgacccaggttgtttggcttggaaaaaaaaaatcacatactcattgcatgattaaacttgtccatcagattgtgattttgtgcgttatgaggattgtagctggggtaattttaaaatgttggtatttggatagaactgccagcccaggattttgataaagatcaaaatatatactgtatctaaagtttcttttttaaaagttatttcacttataatcaaaaggtttaaataagtttagtgtatattttatgattagtattattttgtatcgattcagagagaggaaaactgcattcccatagacagggagacttggtgcattaatatccaaagcttagtttaagctggtgatgattagaaaagtggctttcatttgtgttctctggaagattctcagtagtcctgtgggcatgtgaacaagagcatgtgtaatcttcataatgtatgtcttgttagcagaaatgtctgaggcattgctgagatgtaggatgagctgaggtactggttttgtctttcatggttccctattatgttttttgagaaactgagcttttcctgacagtgtttagtttttcttggctatttactatgctattaatagtaacagtttccattatggagcctcagtaggttcttgacatacattaacccattgctattatgtaattttctaataaaatgatgtgataaaacatattttctgtaatatactcatagaatatgtgattataagtaaataaatagatgttggggtagtcctcca

SEQ ID NO: 355329 - DNA, 6238 bp, Homo sapiens
  misc_feature (1523)..(1523): n is a, c, g, or t
  misc_feature (2061)..(2061): n is a, c, g, or t
  misc_feature (2064)..(2064): n is a, c, g, or t
  misc_feature (2144)..(2144): n is a, c, g, or t
tcagctcggtaccctctctccacactgggggggaggggtcgtgtacattgtcccaccaggcgcaatgtagccgggcggcgcagaggatttcttttttggtcttgagagcatagagtcccttttcatattcacgtgtactcttaagaaagcgtctgttctccaaactggctttccattctccccgtcctaaatggtgcgtggctgacaccgtagtgttttcaaaactggatatggccaggatgctatagcattgtcagtgcatctccttggaaacaatgccatctttgaatgtgagagataaacctagtttcagcatgtctgcagcagagaccagtacatcaggcttattcccacaggaagcctcctaaagcctgtggcgcggcaaccatttccaggactaaataataatgtgtcagatgcctgtgagtggactgcctggccaaatgactcatgaagatattcacggaagaatagtcaaaaaccaaagaaaaggcatattctagaagcaccttcaattccatcgaggatttttgagcagctgaagaagaaagttctgaaaatatgagtgacaggactccagcacattttttttagttgtttcttacattatctttgttaacccatccgcttttgtgtataatattaagttattttccactactgcaatggctagtaatttacttaggctcagagttttactctgtatggacagagaaataggaggtaacaacagtgggagaacaaataggaacagttcactgggatgttggtccccagaaattggctttcattgaataattcctaaagggtgtcgtgtgctgaattgctttttcatagtgatgtgctgcttcttgttcatactcttatgactttaatttcacctttatctactcccagcctctgtatatgcctacgtttttaaaaataatttttggcactgaagatctgattaccatattttttcagtttaaaaattaaatcctcgcaaatagacctttggtatagttgcattctaccctaggttattttctaggatcaagaatagaacaatttctgttctttccagcattactctttactattcatatgttcttgttcagtgttttgttgttctcatattctaggtggaaatgaagggtaatctctatgttctattttcagttttctaggaaaccagaaaaacatgggtagtagaaatgtatagaaaatgtatgaggtctcttaaccattgtgttaaacttgcattaagcttcttttttagcaatatcgatgtcagtgttacctcttctttcctttttatttattttttttgagacagagtctcattctgtcgcccagactggttggagtgcgatgatgcgatcgcggctaactgcaaccgctgcctcccgggtacaagtgattctcgtgccttgggctcccgagtagctgggatttttagtggagaacaggtttcaccatattggccaggctggtcttgaactcgcaacctcaggtgatccacccacctcagcctccccaangtgttgggattacaggcatgagccaccatacctggccccttttgttgttttgaggggcaggcagtaagaagcagggatttcttcaaatgctagtaagcacaaagagagggagaagtttttgtaagtaacgaacagggccgggcatggtggcgtgagaggccgaggtgggcagatcacgaggtcaggagttcgagaccagcctgaccaacatggtgaaacccccgtctccactagaaatgcaaagattagccgggcatggtggtgcacgcctgtaatccagctagtcgggaggctgaggcaggagaatcgcttgaacctgggaggtggaggttgcagggagctgagatcacgccactgcactccagcctgggcgacagagtaagactcccgtctcaaaaaaaaaaaaaaaaaaaaaagaacagttgatcattaaggccattaatgtgcatggacagtttgttgcccaggttggagtgtgatgacgacgcaatctcggtaaatataaacctactctgtaacctccacctcctgggctcangcngttctcgtgcttcagcctcccgagtagctgggatcacaggcatgcgccactaagcccagctaatttttgtatttttagtngagacggggtttcaccatgttggccaggctggtcttgaactcctggcctcaagtgatgcgcctgcctgggcctcccaaagtgctgggattacaggtgtgagccactgcacctggcccaataggcacatttttttaataagtagtttgttgattagaacgaagagcacttgccgtaagtgcatgtcattgttttcagctgttatggctaagtcagttaacctcatcaacaattttttcttctgtaaattgaggacaatttttgcttttatgaatgaagtcttaaccagcaggaagaaatataaacaaaggaacatatttttaatttaatgaagcaaaattccatacatcattttgaaaatagtgtttctttccctgataggcctgttctgcatcattcttttagcttccttctgccctgtttatcacttggtcccacttttatatttttcctcttcggtccagaatttcttatttagtttcttgtattttgcctactccctcccttctccatgattcagcctagtctttccgtcctctgtggacttgggtgtgccttcctctgggccacctcgtcttttgctgctgttagccctcccgcctgcgcacctgccacttcaccctcgcctgtggtccacttacgttccactcagcccggtcagtcctgctttgttcttctccaccgccttggtctcccgtgtgtcttatctagctctggttccttctcgtctccacatttattttgttttcttcctgtgcttgttagtccttgtgcacttggtccttgagctctttttctattaataggtattactagatggatttgttgtctgcctttacatagaacacacatccttactgtgcatttcctgggtagccaggatgaatcaattattattaacttcccttcgaacattgagcttcctctgttttctgtttctaagaattagattagtattctagaagactaatactactttaaagacagtcaaaacagtcatacgctgccatttcagccctttatttaagagtttgtgacatttatcactcccttgaaagattaaagaacacccaaagcaagtttggggtggaggtggggaaggcaggaagagaaaggtaagtgctataaaaggactcattgttaatttctagaaattggactgagatctgaaagcataagccttaacattttttagataaacggtccctgaaaagaataaaaagtatcagtacttccgttaactagctttagtattgggtcatttgtagtttacattctcctttaagttttaagaccttcagtagttaacaaagcagacagagactggccaggcacagtggctcacacctgtaataccagcactttgggaggctgagttgggtggatcacaaggtcaggagattgaaaccatcctggccaacatggtgaaaccccgtctctactaaaaatacaaaaaaaaaaaaaaattagccaggcgtggtggcaggcacctgtggtcccagctactcgggaggctggggcaggagaatttcttgagcccgggaggccgaggttgcagtgagctgagatcgcgccactgcactccagcctgggtgacagcgagactctgtctcaaaaagaaaaaaaaaaaaaaaagcagagacttaatcttgtaaatactcattttatttttgagaggcttaatgtctccttaaatattaacctgtgtcattttgtaattatactgtaatagtgtcagaatgccattaacaaccaacccttttcgtttcttgtgtgggaaagctcataaattgtgtggtcttacccctctggaccctgtagttgtagcattgtgaaaatggagcttttggcaaaactttgtattatgctgttgactcacattgtctcatatttttcctttattcttctatattctatgaatatggtgctgtcctgtcatttaattattataatatatgtgaactgctggaggtagactgatgtgagtgcagtttttcaacttaaaaacccttatatatcacattcatggtgtttaagatataagaacagccctacaaagaggggttgattgtattgaagattctttctgctgagcctgccttaattgtgagggtggttgtttgggtatcttagagctaaaagaatggctaagagtccattaatggtcctgtaatattcaccatccctgagcagttagtaaagaatggccgcaaagccacaattaggctactaacaaggaacttatgtagatgtgctaggtccagcctgtgttctggaactatagagatgaataaggtatggtcctttctctctggaggctcacagttgaatagggaatattaatacgtgaatgatagcagtacagtgtggcagatgctaaaatatatgtgtgtagcagctattacaggagaactgattaatagggagagtctggctgggctcagtgactcacccctgtaatcccagcactttgggaggccgaggcgggcagatcacttgaggtcaggagttcgagaccagcctggccaacatggtaaaacctcatctctactaaaaaatacaaagaaaattagcaaggcgtggtggcgggcatctgtaatcccagctactggggaggctgaagcaggagaatcccttgaacccgggaggtgaggttgcagtgagctgagatcatgccactgcactccagcctgggtgacagagtaagactgtctcaaaaacaaaacccaaaatactaaccatatttatagttagtcacctcaccctttttttagttaaaagaagtttatttagcctgatcagtttaccagatgtcttttttagtgacttttgtgtcttccataaatccattctcaaaatttgcaacagttgagcatatttgaccaaaatgtgccacaggtttctgaagcctgttcaagaagaagcatgtcaacattattggagtaggtcttcgcaatgactacttttgggaagatttgagtaaaatttatggatacagaagttttggagtatgttagaatattactaagtctttttatagttgtaatcccaacactgggttatatatatttaataccaacctgagtatatttcctgaataatatctgttttggagacttggacaaagttaacttttttgcttttttaaaagttgctgtttaaattaacttcctgcatttctaatgtagaaaaaatatggcacagtgatttgaattttgtttatggtttattatcttcctaaattatcagctctttaaaatatgggtctctggcctgtataccatctgataaattaggttgggtaaatttttcacctgaaaaaattcattcttttgacccaggttgtttggcttggaaaaaaaaaatcacatactcattgcatgattaaacttgtccatcagattgtgattttgtgcgttatgaggattgtagctggggtaattttaaaatgttggtatttggatagaactgccagcccaggattttgataaagatcaaaatatatactgtatctaaagtttcttttttaaaagttatttcacttataatcaaaaggtttaaataagtttagtgtatattttatgattagtattattttgtatcgattcagagagaggaaaactgcattcccatagacagggagacttggtgcattaatatccaaagcttagtttaagctggtgatgattagaaaagtggctttcatttgtgttctctggaagattctcagtagtcctgtgggcatgtgaacaagagcatgtgtaatcttcataatgtatgtcttgttagcagaaatgtctgaggcattgctgagatgtaggatgagctgaggtactggttttgtctttcatggttccctattatgttttttgagaaactgagcttttcctgacagtgtttagtttttcttggctatttactatgctattaatagtaacagtttccattatggagcctcagtaggttcttgacatacattaacccattgctattatgtaattttctaataaaatgatgtgataaaacatattttctgtaatatactcatagaatatgtgattataagtaaataaatagatgttggggtagtcctcca

SEQ ID NO: 355330 - DNA, 6641 bp, Homo sapiens
  misc_feature (1846)..(1846): n is a, c, g, or t
  misc_feature (2384)..(2384): n is a, c, g, or t
  misc_feature (2387)..(2387): n is a, c, g, or t
  misc_feature (2467)..(2467): n is a, c, g, or t
agccggagagacgcagcggcggccccagtgccgcccccgggcgcgtgagtggagccgggctcctttcccctaccgcgccgcgacccccgcccgggctgcgcgcgccgcctcccgcgagcccccggcccgactcccgggctcccgcgggtgggggccagggctggtcggcgccggcggggctcgcggcggcggcgggttgcgtcccccgcgcctgctggcccacgtggacctggccgtcgcttgccgtgcggcgcctttgcgaaaactcgacggaagtggcagggaccgggcattacctgcgagtgccgggcgcctcctgctccgctgtgcgcgcttggggtgggactcggcgggggaggggtcgtgtacattgtcccaccaggcgcaatgtagccgggcggcgcagaggatttcttttttggtcttgagagcatagagtcccttttcatattcacgtgtactcttaagaaagcgtctgttctccaaactggctttccattctccccgtcctaaatggtgcgtggctgacaccgtagtgttttcaaaactggatatggccaggatgctatagcattgtcagtgcatctccttggaaacaatgccatctttgaatgtgagagataaacctagtttcagcatgtctgcagcagagaccagtacatcaggcttattcccacaggaagcctcctaaagcctgtggcgcggcaaccatttccaggactaaataataatgtgtcagatgcctgtgagtggactgcctggccaaatgactcatgaagatattcacggaagaatagtcaaaaaccaaagaaaaggcatattctagaagcaccttcaattccatcgaggatttttgagcagctgaagaagaaagttctgaaaatatgagtgacaggactccagcacattttttttagttgtttcttacattatctttgttaacccatccgcttttgtgtataatattaagttattttccactactgcaatggctagtaatttacttaggctcagagttttactctgtatggacagagaaataggaggtaacaacagtgggagaacaaataggaacagttcactgggatgttggtccccagaaattggctttcattgaataattcctaaagggtgtcgtgtgctgaattgctttttcatagtgatgtgctgcttcttgttcatactcttatgactttaatttcacctttatctactcccagcctctgtatatgcctacgtttttaaaaataatttttggcactgaagatctgattaccatattttttcagtttaaaaattaaatcctcgcaaatagacctttggtatagttgcattctaccctaggttattttctaggatcaagaatagaacaatttctgttctttccagcattactctttactattcatatgttcttgttcagtgttttgttgttctcatattctaggtggaaatgaagggtaatctctatgttctattttcagttttctaggaaaccagaaaaacatgggtagtagaaatgtatagaaaatgtatgaggtctcttaaccattgtgttaaacttgcattaagcttcttttttagcaatatcgatgtcagtgttacctcttctttcctttttatttattttttttgagacagagtctcattctgtcgcccagactggttggagtgcgatgatgcgatcgcggctaactgcaaccgctgcctcccgggtacaagtgattctcgtgccttgggctcccgagtagctgggatttttagtggagaacaggtttcaccatattggccaggctggtcttgaactcgcaacctcaggtgatccacccacctcagcctccccaangtgttgggattacaggcatgagccaccatacctggccccttttgttgttttgaggggcaggcagtaagaagcagggatttcttcaaatgctagtaagcacaaagagagggagaagtttttgtaagtaacgaacagggccgggcatggtggcgtgagaggccgaggtgggcagatcacgaggtcaggagttcgagaccagcctgaccaacatggtgaaacccccgtctccactagaaatgcaaagattagccgggcatggtggtgcacgcctgtaatccagctagtcgggaggctgaggcaggagaatcgcttgaacctgggaggtggaggttgcagggagctgagatcacgccactgcactccagcctgggcgacagagtaagactcccgtctcaaaaaaaaaaaaaaaaaaaaaagaacagttgatcattaaggccattaatgtgcatggacagtttgttgcccaggttggagtgtgatgacgacgcaatctcggtaaatataaacctactctgtaacctccacctcctgggctcangcngttctcgtgcttcagcctcccgagtagctgggatcacaggcatgcgccactaagcccagctaatttttgtatttttagtngagacggggtttcaccatgttggccaggctggtcttgaactcctggcctcaagtgatgcgcctgcctgggcctcccaaagtgctgggattacaggtgtgagccactgcacctggcccaataggcacatttttttaataagtagtttgttgattagaacgaagagcacttgccgtaagtgcatgtcattgttttcagctgttatggctaagtcagttaacctcatcaacaattttttcttctgtaaattgaggacaatttttgcttttatgaatgaagtcttaaccagcaggaagaaatataaacaaaggaacatatttttaatttaatgaagcaaaattccatacatcattttgaaaatagtgtttctttccctgataggcctgttctgcatcattcttttagcttccttctgccctgtttatcacttggtcccacttttatatttttcctcttcggtccagaatttcttatttagtttcttgtattttgcctactccctcccttctccatgattcagcctagtctttccgtcctctgtggacttgggtgtgccttcctctgggccacctcgtcttttgctgctgttagccctcccgcctgcgcacctgccacttcaccctcgcctgtggtccacttacgttccactcagcccggtcagtcctgctttgttcttctccaccgccttggtctcccgtgtgtcttatctagctctggttccttctcgtctccacatttattttgttttcttcctgtgcttgttagtccttgtgcacttggtccttgagctctttttctattaataggtattactagatggatttgttgtctgcctttacatagaacacacatccttactgtgcatttcctgggtagccaggatgaatcaattattattaacttcccttcgaacattgagcttcctctgttttctgtttctaagaattagattagtattctagaagactaatactactttaaagacagtcaaaacagtcatacgctgccatttcagccctttatttaagagtttgtgacatttatcactcccttgaaagattaaagaacacccaaagcaagtttggggtggaggtggggaaggcaggaagagaaaggtaagtgctataaaaggactcattgttaatttctagaaattggactgagatctgaaagcataagccttaacattttttagataaacggtccctgaaaagaataaaaagtatcagtacttccgttaactagctttagtattgggtcatttgtagtttacattctcctttaagttttaagaccttcagtagttaacaaagcagacagagactggccaggcacagtggctcacacctgtaataccagcactttgggaggctgagttgggtggatcacaaggtcaggagattgaaaccatcctggccaacatggtgaaaccccgtctctactaaaaatacaaaaaaaaaaaaaaattagccaggcgtggtggcaggcacctgtggtcccagctactcgggaggctggggcaggagaatttcttgagcccgggaggccgaggttgcagtgagctgagatcgcgccactgcactccagcctgggtgacagcgagactctgtctcaaaaagaaaaaaaaaaaaaaaagcagagacttaatcttgtaaatactcattttatttttgagaggcttaatgtctccttaaatattaacctgtgtcattttgtaattatactgtaatagtgtcagaatgccattaacaaccaacccttttcgtttcttgtgtgggaaagctcataaattgtgtggtcttacccctctggaccctgtagttgtagcattgtgaaaatggagcttttggcaaaactttgtattatgctgttgactcacattgtctcatatttttcctttattcttctatattctatgaatatggtgctgtcctgtcatttaattattataatatatgtgaactgctggaggtagactgatgtgagtgcagtttttcaacttaaaaacccttatatatcacattcatggtgtttaagatataagaacagccctacaaagaggggttgattgtattgaagattctttctgctgagcctgccttaattgtgagggtggttgtttgggtatcttagagctaaaagaatggctaagagtccattaatggtcctgtaatattcaccatccctgagcagttagtaaagaatggccgcaaagccacaattaggctactaacaaggaacttatgtagatgtgctaggtccagcctgtgttctggaactatagagatgaataaggtatggtcctttctctctggaggctcacagttgaatagggaatattaatacgtgaatgatagcagtacagtgtggcagatgctaaaatatatgtgtgtagcagctattacaggagaactgattaatagggagagtctggctgggctcagtgactcacccctgtaatcccagcactttgggaggccgaggcgggcagatcacttgaggtcaggagttcgagaccagcctggccaacatggtaaaacctcatctctactaaaaaatacaaagaaaattagcaaggcgtggtggcgggcatctgtaatcccagctactggggaggctgaagcaggagaatcccttgaacccgggaggtgaggttgcagtgagctgagatcatgccactgcactccagcctgggtgacagagtaagactgtctcaaaaacaaaacccaaaatactaaccatatttatagttagtcacctcaccctttttttagttaaaagaagtttatttagcctgatcagtttaccagatgtcttttttagtgacttttgtgtcttccataaatccattctcaaaatttgcaacagttgagcatatttgaccaaaatgtgccacaggtttctgaagcctgttcaagaagaagcatgtcaacattattggagtaggtcttcgcaatgactacttttgggaagatttgagtaaaatttatggatacagaagttttggagtatgttagaatattactaagtctttttatagttgtaatcccaacactgggttatatatatttaataccaacctgagtatatttcctgaataatatctgttttggagacttggacaaagttaacttttttgcttttttaaaagttgctgtttaaattaacttcctgcatttctaatgtagaaaaaatatggcacagtgatttgaattttgtttatggtttattatcttcctaaattatcagctctttaaaatatgggtctctggcctgtataccatctgataaattaggttgggtaaatttttcacctgaaaaaattcattcttttgacccaggttgtttggcttggaaaaaaaaaatcacatactcattgcatgattaaacttgtccatcagattgtgattttgtgcgttatgaggattgtagctggggtaattttaaaatgttggtatttggatagaactgccagcccaggattttgataaagatcaaaatatatactgtatctaaagtttcttttttaaaagttatttcacttataatcaaaaggtttaaataagtttagtgtatattttatgattagtattattttgtatcgattcagagagaggaaaactgcattcccatagacagggagacttggtgcattaatatccaaagcttagtttaagctggtgatgattagaaaagtggctttcatttgtgttctctggaagattctcagtagtcctgtgggcatgtgaacaagagcatgtgtaatcttcataatgtatgtcttgttagcagaaatgtctgaggcattgctgagatgtaggatgagctgaggtactggttttgtctttcatggttccctattatgttttttgagaaactgagcttttcctgacagtgtttagtttttcttggctatttactatgctattaatagtaacagtttccattatggagcctcagtaggttcttgacatacattaacccattgctattatgtaattttctaataaaatgatgtgataaaacatattttctgtaatatactcatagaatatgtgattataagtaaataaatagatgttggggtagtcctccaaaatggaaactgttactattaatagcatagtaaatagccaagaaaaactaaacactgtcaggaaaagctcagtttctgtc

SEQ ID NO: 355331 - DNA, 4519 bp, Homo sapiens
agccggagagacgcagcggcggccccagtgccgcccccgggcgcgtgagtggagccgggctcctttcccctaccgcgccgcgacccccgcccgggctgcgcgcgccgcctcccgcgagcccccggcccgactcccgggctcccgcgggtgggggccagggctggtcggcgccggcggggctcgcggcggcggcgggttgcgtcccccgcgcctgctggcccacgtggacctggccgtcgcttgccgtgcggcgcctttgcgaaaactcgacggaagtggcagggaccgggcattacctgcgagtgccgggcgcctcctgctccgctgtgcgcgcttggggtgggactcggcgggggaggggtcgtgtacattgtcccaccaggcgcaatgtagccgggcggcgcagaggatttcttttttggtcttgagagcatagagtcccttttcatattcacgtgtactcttaagaaagcgtctgttctccaaactggctttccattctccccgtcctaaatggtgcgtggctgacaccgtagtgttttcaaaactggatatggccaggatgctatagcattgtcagtgcatctccttggaaacaatgccatctttgaatgtgagagataaacctagtttcagcatgtctgcagcagagaccagtacatcaggcttattcccacaggaagcctcctaaagcctgtggcgcggcaaccatttccaggactaaataataatgtgtcagatgcctgtgagtggactgcctggccaaatgactcatgaagatattcacggaagaatagtcaaaaaccaaagaaaaggcatattctagaagcaccttcaattccatcgaggatttttgagcagctgaagaagaaagttctgaaaatatgagtgacaggactccagcacattttttttagttgtttcttacattatctttgttaacccatccgcttttgtgtataatattaagttattttccactactgcaatggctagtaatttacttaggctcagagttttactctgtatggacagagaaataggaggtaacaacagtgggagaacaaataggaacagttcactgggatgttggtccccagaaattggctttcattgaataattcctaaagggtgtcgtgtgctgaattgctttttcatagtgatgtgctgcttcttgttcatactcttatgactttaatttcacctttatctactcccagcctctgtatatgcctacgtttttaaaaataatttttggcactgaagatctgattaccatattttttcagtttaaaaattaaatcctcgcaaatagacctttggtatagttgcattctaccctaggttattttctaggatcaagaatagaacaatttctgttctttccagcattactctttactattcatatgttcttgttcagtgttttgttgttctcatattctaggtggaaatgaagggtaatctctatgttctattttcagttttctaggaaaccagaaaaacatgggtagtagaaatgtatagaaaatgtatgaggtctcttaaccattgtgttaaacttgcattaagcttcttttttagcaatatcgatgtcagtgttacctcttctttcctttttatttattttttttgagacagagtctcattctgtcgcccagactggttggagtgcgatgatgcgatcgcggctaactgcaaccgctgcctcccgggtacaagtgattctcgtgccttgggctcccgagtagctgggatttttagtggagaacaggtttcaccatattggccaggctgagttgggtggatcacaaggtcaggagattgaaaccatcctggccaacatggtgaaaccccgtctctactaaaaatacaaaaaaaaaaaaaaattagccaggcgtggtggcaggcacctgtggtcccagctactcgggaggctggggcaggagaatttcttgagcccgggaggccgaggttgcagtgagctgagatcgcgccactgcactccagcctgggtgacagcgagactctgtctcaaaaagaaaaaaaaaaaaaaaagcagagacttaatcttgtaaatactcattttatttttgagaggcttaatgtctccttaaatattaacctgtgtcattttgtaattatactgtaatagtgtcagaatgccattaacaaccaacccttttcgtttcttgtgtgggaaagctcataaattgtgtggtcttacccctctggaccctgtagttgtagcattgtgaaaatggagcttttggcaaaactttgtattatgctgttgactcacattgtctcatatttttcctttattcttctatattctatgaatatggtgctgtcctgtcatttaattattataatatatgtgaactgctggaggtagactgatgtgagtgcagtttttcaacttaaaaacccttatatatcacattcatggtgtttaagatataagaacagccctacaaagaggggttgattgtattgaagattctttctgctgagcctgccttaattgtgagggtggttgtttgggtatcttagagctaaaagaatggctaagagtccattaatggtcctgtaatattcaccatccctgagcagttagtaaagaatggccgcaaagccacaattaggctactaacaaggaacttatgtagatgtgctaggtccagcctgtgttctggaactatagagatgaataaggtatggtcctttctctctggaggctcacagttgaatagggaatattaatacgtgaatgatagcagtacagtgtggcagatgctaaaatatatgtgtgtagcagctattacaggagaactgattaatagggagagtctggctgggctcagtgactcacccctgtaatcccagcactttgggaggccgaggcgggcagatcacttgaggtcaggagttcgagaccagcctggccaacatggtaaaacctcatctctactaaaaaatacaaagaaaattagcaaggcgtggtggcgggcatctgtaatcccagctactggggaggctgaagcaggagaatcccttgaacccgggaggtgaggttgcagtgagctgagatcatgccactgcactccagcctgggtgacagagtaagactgtctcaaaaacaaaacccaaaatactaaccatatttatagttagtcacctcaccctttttttagttaaaagaagtttatttagcctgatcagtttaccagatgtcttttttagtgacttttgtgtcttccataaatccattctcaaaatttgcaacagttgagcatatttgaccaaaatgtgccacaggtttctgaagcctgttcaagaagaagcatgtcaacattattggagtaggtcttcgcaatgactacttttgggaagatttgagtaaaatttatggatacagaagttttggagtatgttagaatattactaagtctttttatagttgtaatcccaacactgggttatatatatttaataccaacctgagtatatttcctgaataatatctgttttggagacttggacaaagttaacttttttgcttttttaaaagttgctgtttaaattaacttcctgcatttctaatgtagaaaaaatatggcacagtgatttgaattttgtttatggtttattatcttcctaaattatcagctctttaaaatatgggtctctggcctgtataccatctgataaattaggttgggtaaatttttcacctgaaaaaattcattcttttgacccaggttgtttggcttggaaaaaaaaaatcacatactcattgcatgattaaacttgtccatcagattgtgattttgtgcgttatgaggattgtagctggggtaattttaaaatgttggtatttggatagaactgccagcccaggattttgataaagatcaaaatatatactgtatctaaagtttcttttttaaaagttatttcacttataatcaaaaggtttaaataagtttagtgtatattttatgattagtattattttgtatcgattcagagagaggaaaactgcattcccatagacagggagacttggtgcattaatatccaaagcttagtttaagctggtgatgattagaaaagtggctttcatttgtgttctctggaagattctcagtagtcctgtgggcatgtgaacaagagcatgtgtaatcttcataatgtatgtcttgttagcagaaatgtctgaggcattgctgagatgtaggatgagctgaggtactggttttgtctttcatggttccctattatgttttttgagaaactgagcttttcctgacagtgtttagtttttcttggctatttactatgctattaatagtaacagtttccattatggagcctcagtaggttcttgacatacattaacccattgctattatgtaattttctaataaaatgatgtgataaaacatattttctgtaatatactcatagaatatgtgattataagtaaataaatagatgttggggtagtcctcca

SEQ ID NO: 355332 - DNA, 4294 bp, Homo sapiens
agccggagagacgcagcggcggccccagtgccgcccccgggcgcgtgagtggagccgggctcctttcccctaccgcgccgcgacccccgcccgggctgcgcgcgccgcctcccgcgagcccccggcccgactcccgggctcccgcgggtgggggccagggctggtcggcgccggcggggctcgcggcggcggcgggttgcgtcccccgcgcctgctggcccacgtggacctggccgtcgcttgccgtgcggcgcctttgcgaaaactcgacggaagtggcagggaccgggcattacctgcgagtgccgggcgcctcctgctccgctgtgcgcgcttggggtgggactcggcgggggaggggtcgtgtacattgtcccaccaggcgcaatgtagccgggcggcgcagaggatttcttttttggtcttgagagcatagagtcccttttcatattcacgtgtactcttaagaaagcgtctgttctccaaactggctttccattctccccgtcctaaatggtgcgtggctgacaccgtagtgttttcaaaactggatatggccaggatgctatagcattgtcagtgcatctccttggaaacaatgccatctttgaatgtgagagataaacctagtttcagcatgtctgcagcagagaccagtacatcaggcttattcccacaggaagcctcctaaagcctgtggcgcggcaaccatttccaggactaaataataatgtgtcagatgcctgtgagtggactgcctggccaaatgactcatgaagatattcacggaagaatagtcaaaaaccaaagaaaaggcatattctagaagcaccttcaattccatcgaggatttttgagcagctgaagaagaaagttctgaaaatatgagtgacaggactccagcacattttttttagttgtttcttacattatctttgttaacccatccgcttttgtgtataatattaagttattttccactactgcaatggctagtaatttacttaggctcagagttttactctgtatggacagagaaataggaggtaacaacagtgggagaacaaataggaacagttcactgggatgttggtccccagaaattggctttcattgaataattcctaaagggtgtcgtgtgctgaattgctttttcatagtgatgtgctgcttcttgttcatactcttatgactttaatttcacctttatctactcccagcctctgtatatgcctacgtttttaaaaataatttttggcactgaagatctgattaccatattttttcagtttaaaaattaaatcctcgcaaatagacctttggtatagttgcattctaccctaggttattttctaggatcaagaatagaacaatttctgttctttccagcattactctttactattcatatgttcttgttcagtgttttgttgttctcatattctaggtggaaatgaagggtaatctctatgttctattttcagttttctaggaaaccagaaaaacatgggtagtagaaatgtatagaaaatgtatgaggtctcttaaccattgtgttaaacttgcattaagcttcttttttagcaatatcgatgtcagtgttacctcttctttcctttttatttattttttttgagacagagtctcattctgtcgcccagactggttggagtgcgatgatgcgatcgcggctaactgcaaccgctgcctcccgggtacaagagaatttcttgagcccgggaggccgaggttgcagtgagctgagatcgcgccactgcactccagcctgggtgacagcgagactctgtctcaaaaagaaaaaaaaaaaaaaaagcagagacttaatcttgtaaatactcattttatttttgagaggcttaatgtctccttaaatattaacctgtgtcattttgtaattatactgtaatagtgtcagaatgccattaacaaccaacccttttcgtttcttgtgtgggaaagctcataaattgtgtggtcttacccctctggaccctgtagttgtagcattgtgaaaatggagcttttggcaaaactttgtattatgctgttgactcacattgtctcatatttttcctttattcttctatattctatgaatatggtgctgtcctgtcatttaattattataatatatgtgaactgctggaggtagactgatgtgagtgcagtttttcaacttaaaaacccttatatatcacattcatggtgtttaagatataagaacagccctacaaagaggggttgattgtattgaagattctttctgctgagcctgccttaattgtgagggtggttgtttgggtatcttagagctaaaagaatggctaagagtccattaatggtcctgtaatattcaccatccctgagcagttagtaaagaatggccgcaaagccacaattaggctactaacaaggaacttatgtagatgtgctaggtccagcctgtgttctggaactatagagatgaataaggtatggtcctttctctctggaggctcacagttgaatagggaatattaatacgtgaatgatagcagtacagtgtggcagatgctaaaatatatgtgtgtagcagctattacaggagaactgattaatagggagagtctggctgggctcagtgactcacccctgtaatcccagcactttgggaggccgaggcgggcagatcacttgaggtcaggagttcgagaccagcctggccaacatggtaaaacctcatctctactaaaaaatacaaagaaaattagcaaggcgtggtggcgggcatctgtaatcccagctactggggaggctgaagcaggagaatcccttgaacccgggaggtgaggttgcagtgagctgagatcatgccactgcactccagcctgggtgacagagtaagactgtctcaaaaacaaaacccaaaatactaaccatatttatagttagtcacctcaccctttttttagttaaaagaagtttatttagcctgatcagtttaccagatgtcttttttagtgacttttgtgtcttccataaatccattctcaaaatttgcaacagttgagcatatttgaccaaaatgtgccacaggtttctgaagcctgttcaagaagaagcatgtcaacattattggagtaggtcttcgcaatgactacttttgggaagatttgagtaaaatttatggatacagaagttttggagtatgttagaatattactaagtctttttatagttgtaatcccaacactgggttatatatatttaataccaacctgagtatatttcctgaataatatctgttttggagacttggacaaagttaacttttttgcttttttaaaagttgctgtttaaattaacttcctgcatttctaatgtagaaaaaatatggcacagtgatttgaattttgtttatggtttattatcttcctaaattatcagctctttaaaatatgggtctctggcctgtataccatctgataaattaggttgggtaaatttttcacctgaaaaaattcattcttttgacccaggttgtttggcttggaaaaaaaaaatcacatactcattgcatgattaaacttgtccatcagattgtgattttgtgcgttatgaggattgtagctggggtaattttaaaatgttggtatttggatagaactgccagcccaggattttgataaagatcaaaatatatactgtatctaaagtttcttttttaaaagttatttcacttataatcaaaaggtttaaataagtttagtgtatattttatgattagtattattttgtatcgattcagagagaggaaaactgcattcccatagacagggagacttggtgcattaatatccaaagcttagtttaagctggtgatgattagaaaagtggctttcatttgtgttctctggaagattctcagtagtcctgtgggcatgtgaacaagagcatgtgtaatcttcataatgtatgtcttgttagcagaaatgtctgaggcattgctgagatgtaggatgagctgaggtactggttttgtctttcatggttccctattatgttttttgagaaactgagcttttcctgacagtgtttagtttttcttggctatttactatgctattaatagtaacagtttccattatggagcctcagtaggttcttgacatacattaacccattgctattatgtaattttctaataaaatgatgtgataaaacatattttctgtaatatactcatagaatatgtgattataagtaaataaatagatgttggggtagtcctcca

SEQ ID NO: 355333 - DNA, 2675 bp, Homo sapiens
  misc_feature (1846)..(1846): n is a, c, g, or t
  misc_feature (2287)..(2287): n is a, c, g, or t
agccggagagacgcagcggcggccccagtgccgcccccgggcgcgtgagtggagccgggctcctttcccctaccgcgccgcgacccccgcccgggctgcgcgcgccgcctcccgcgagcccccggcccgactcccgggctcccgcgggtgggggccagggctggtcggcgccggcggggctcgcggcggcggcgggttgcgtcccccgcgcctgctggcccacgtggacctggccgtcgcttgccgtgcggcgcctttgcgaaaactcgacggaagtggcagggaccgggcattacctgcgagtgccgggcgcctcctgctccgctgtgcgcgcttggggtgggactcggcgggggaggggtcgtgtacattgtcccaccaggcgcaatgtagccgggcggcgcagaggatttcttttttggtcttgagagcatagagtcccttttcatattcacgtgtactcttaagaaagcgtctgttctccaaactggctttccattctccccgtcctaaatggtgcgtggctgacaccgtagtgttttcaaaactggatatggccaggatgctatagcattgtcagtgcatctccttggaaacaatgccatctttgaatgtgagagataaacctagtttcagcatgtctgcagcagagaccagtacatcaggcttattcccacaggaagcctcctaaagcctgtggcgcggcaaccatttccaggactaaataataatgtgtcagatgcctgtgagtggactgcctggccaaatgactcatgaagatattcacggaagaatagtcaaaaaccaaagaaaaggcatattctagaagcaccttcaattccatcgaggatttttgagcagctgaagaagaaagttctgaaaatatgagtgacaggactccagcacattttttttagttgtttcttacattatctttgttaacccatccgcttttgtgtataatattaagttattttccactactgcaatggctagtaatttacttaggctcagagttttactctgtatggacagagaaataggaggtaacaacagtgggagaacaaataggaacagttcactgggatgttggtccccagaaattggctttcattgaataattcctaaagggtgtcgtgtgctgaattgctttttcatagtgatgtgctgcttcttgttcatactcttatgactttaatttcacctttatctactcccagcctctgtatatgcctacgtttttaaaaataatttttggcactgaagatctgattaccatattttttcagtttaaaaattaaatcctcgcaaatagacctttggtatagttgcattctaccctaggttattttctaggatcaagaatagaacaatttctgttctttccagcattactctttactattcatatgttcttgttcagtgttttgttgttctcatattctaggtggaaatgaagggtaatctctatgttctattttcagttttctaggaaaccagaaaaacatgggtagtagaaatgtatagaaaatgtatgaggtctcttaaccattgtgttaaacttgcattaagcttcttttttagcaatatcgatgtcagtgttacctcttctttcctttttatttattttttttgagacagagtctcattctgtcgcccagactggttggagtgcgatgatgcgatcgcggctaactgcaaccgctgcctcccgggtacaagtgattctcgtgccttgggctcccgagtagctgggatttttagtggagaacaggtttcaccatattggccaggctggtcttgaactcgcaacctcaggtgatccacccacctcagcctccccaangtgttgggattacaggcatgagccaccatacctggccccttttgttgttttgaggggcaggcagtaagaagcagggatttcttcaaatgctagtaagcacaaagagagggagaagtttttgtaagtaacgaacagggccgggcatggtggcgtgagaggccgaggtgggcagatcacgaggtcaggagttcgagaccagcctgaccaacatggtgaaacccccgtctccactagaaatgcaaagattagccgggcatggtggtgcacgcctgtaatccagctagtcgggaggctgaggcaggagaatcgcttgaacctgggaggtggaggttgcagggagctgagatcacgccactgcactccagcctgggcgacagagtaagactcccgtctcaaaaaaaaaaaaaaaaaaaaaaaaaaaaaaaaaaaaaaaaaaaaaanaaaaaaaaaagacaagggggcggcgcgcgcgccgcgacaaatgatcctccgccacgggggaggacaactcatcggcagcccccacccaatattctttagaaaaaggggcgccgccacgaaaaagaggaggatggcattatatcaaaacagcagcgaggcggaccgcggcagcgcccgcaacacaacaggatgcaggtggcgcggggcgggacacataggctgctgctcggaggcgaatcctctgagtgggcgggagggcccctttttcttgtgggggggggggacgtaacatctactgtgggcacgcttcatcatccccatagaaatgtaattatacgcctgcagttgagtgtggattatcaacaacttgcttgtgttgctagtttgc

SEQ ID NO: 355334 - DNA, 2815 bp, Homo sapiens
acctaagcaagcctgggcaatggcgggcgcccctcccccagcctcgctgccgccttgcagtttgatctcagactgctgtgctggcaatcagcgagactccgtgggcgtaggaccctccgagccaggctgctatccatgtccagggccaaacatgaatcctattgctcttgggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatgggaaactgaacagccaagactcctataacaattttaccaacaacaaccctggcaaccctcggctctctcctcttcccagcttgatggtagtgatgcctcttgcacaaatcaagcagccaatgacattggggaccatcaccaaacgaaccggcaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttagaacccctcaatggaatgaattgcagccaccgtttaatgcaaaccaccctctgctcctcgctgcagatgcagtacagtattatcagttcctgcttgctggcctggttccccctggaagtcctgggcccattactcgacatgggtcttacgacagtttagcttctgaccatagtggacaggaagatgaagaatggctttcccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggatccagccagtccgctctgaccccgtcagcatgccagggtcatcccgtccagtctctgatcgaaggggagtttccacagtgattgatgctgcctcaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcctgggaagagtttgtctttcttatctttaagcccctttaccctggtcctgtactgatcagtgaaggaaaccgtggttactgaggccctgttgaaaagtgcacgtcttgtccaataaatcacgctgcagttggtgtccaaaaaaaaat

SEQ ID NO: 355335 - DNA, 2053 bp, Homo sapiens
ccccatgattcaattatctccacctggtccctcccaggacacatggggattatgggaactacaagtcaagatgagatttgggtggagacacagccaaacgatatcagggtgttgtgaggattcatggagcaaatggctgtgaaagcaccttgtaaagggtagagcagtgtgcggcgtgagggattattatcattgttaagacgtctacgcctcgttgctcaccctgtgtgatcctgcagcttctcaacttttccctcctttctccctggtttccacgcctgggctgctgagtcaggcggaccggccaaggctggcgagggctgaacagatgctctgacatgtcaaggcaggaaatgacagttcccaggcagccctctgtttcaggtgtggaacaggctccgaacacactttgtgtgataaattctagtaacgccaggctgagctctacctccacccccttaggctgcaagactaggacatgaggctgaaagtcagagaagtccctgtgagacgagggccctgagcaagcactggccagactgtagcaaggccactcaccaggccaccccgctggttctacttccgcacccacctctggcagccatgatgcttctgcagcatgccagtttgttcactgagaccttcacagaaggtcgcacaaccaccctggacggtgagaaactaaggtgactgaggcaagtcattgaaccaccctgagccttggcttcctcatctatgaaatggagttgacagcatctgtcctgcctgtggtaaaaattgctgtgatcccacaaccaaaaggaaagagagaattatgagaaaaatatgtacttattctgtgaaaatatgtgagattttcatgagagacttcctgttccagtggactcttccaccgcccttgagtggggaacatccaggccttcacactcacgctcagcccatcacccctctgtgcaaggtgcaaggtcctctgcccacctgaagcctcaaggcctgatggaaaccatccacagccactctagtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcctgggaagagtttgtctttcttatctttaagcccctttaccctggtcctgtactgatcagtgaaggaaaccgtggttactgaggccctgttgaaaagtgcacgtcttgtccaataaatcacgctgcagttggtgtccaaaaaaaaat

SEQ ID NO: 355336 - DNA, 598 bp, Homo sapiens
gttaacaggcggggcggccggttttatgaatgaagctatggctacagattccccaagaagacccagtcgttgtactggtggagttgtggttcgcccccaggctgtcacatggagtctcactctgttgcccaggttggagtgcagtggcgccgtctcggctcgctgcagcctccacctcctcctctgtctcccagattcaagcgattctcctgccttggcctcccaagtagctgggattacaggcgagcgccaccaggcctggccaaattttgtatttttagcaaagacggggttttgccatttggccaggctggtcttgaactcctgacctcaggtgatctgcctgtcttggcctcccaaagtgctagaattacatgtgtgagccactgtgcctggccaaagatatgtatacttgaaggctgacatgggaggattgcttgaaaccaggagtttgacaccagcctgaacaacatcctgagaccctcatgccttaaaaaaatacaaaaattagccaggcattgtggcaggcgcctggagccttagctactcgggaggctgagatgggaggatcacctcggcccaggagcttgaagctgtg

SEQ ID NO: 355337 - DNA, 3483 bp, Homo sapiens
aggaccagtggagaatttaatcctggtttattgcgtagcatgtgaaataatcatgcatatcaaagtagtgattcattttgaaaattggcagtttgctttatttatgtcagtcacaaataaggatatgtctttttcattcctaatggtaaaagtttaagctctctgaagtggacagctaatatacttgtcatagttgatttatgcgtaatttgtaatgcttttccactgacacaattgaaaatataaatatggcaaaatcttttgtctactttttatgttttcttttataatctttgtggaggagttaacaggataaaacatctaatttgttagcatgtcagatatttaagttaggaagtcatgtgtaagtcctttgattacgtttttaaaatttatttgtggaaaggccaccagaccccaatcctaccatttcagagtttatggattcttaaagaccattcttcttgtaatgaaaaccgtagttgagcatgaaactgcctgagtggcaccagtagattataaaaaggggtagaagtgtctcggcaaagcttttagctgtttgtctgaaatacactcatgcaaacattcccacccatcaccatcactgttcacggaaaataagctctatcctgatagcctgtagagttaaacagattaatagaaatgacgttctgcttctctctctctctttttctcagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaagtacaggacatctgcttcagccatgactgtcgctgggttgtggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatgggaaactgaacagccaagactcctataacaattttaccaacaacaaccctggcaaccctcggctctctcctcttcccagcttgatggtagtgatgcctcttgcacaaatcaagcagccaatgacattggggaccatcaccaaacgaaccggcaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttagaacccctcaatggaatgaattgcagccaccgtttaatgcaaaccaccctctgctcctcgctgcagatgcagtacagtattatcagttcctgcttgctggcctggttccccctggaagtcctgggcccattactcgacatgggtcttacgacagtttagcttctgaccatagtggacaggaagatgaagaatggctttcccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggatccagccagtccgctctgaccccgtcagcatgccagggtcatcccgtccagtctctgatcgaaggggagtttccacagtgattgatgctgcctcaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagacacagcccttgacgtagcagtaaaaaccttcccccctgagagacacgtggcagtgaagtgttttgaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcctgggaagagtttgtctttcttatctttaagcccctttaccctggtcctgtactgatcagtgaaggaaaccgtggttactgaggccctgttgaaaagtgcacgtcttgtccaataaatcacgctgcagttggtgtccaaaaaaaaat

SEQ ID NO: 355338 - DNA, 3728 bp, Homo sapiens
aggaagtggctgccgtcaatcactcggggagactccaaacagtgagcctagagctggagactagcgttaaccggcggggcggccggttttatgaatgaagctatggctacagattccccaagaagacccagtcgttgtactggtggagttgtggttcgcccccaggctgtcacagagcagtcctacatggaaagtgttgtgacttttctgcaggatgttgtgccacaggcttccaggaagcagctgataggttgggtctagaagcttgataagagactaaaaaagtacagtaatactcacaccagtataattgccacaaacacctagcacttaatagttaaaggcttacagtggaacacctctaacagaagaaaaggagaaaatagtctgggtcagatttgaaaatgcagatttaaatgatacatcaagaaatctggaatttcatgaaatacatagtactgggagtgaaccgcctttgttgattatgattggctacagtgatggaatgcaggtctggagcatccctatcagtggcgaagcacaagagctcttctctgttcgacatggcccaattcgagcggctagaatcttgcctgctccacagtttggtgctcaaaaatgtgataactttgctgaaaaaagacccctccttggtgtttgtaagagcattggatcttctggcacaagcccaccgtactgttgtgtggatctgtattcacttcgtactggggagatggtcaagtccattcaatttaagacacctatttatgatctccattgcaataaacggatccttgtcgtagtcttgcaggagaaaattgctgcctttgatagctgtactttcacgaagaaattctttgttacaagctgctatccatgtccagggccaaacatgaatcctattgctcttgggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaagtacaggacatctgcttcagccatgactgtcgctgggttgtggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatgggaaactgaacagccaagactcctataacaattttaccaacaacaaccctggcaaccctcggctctctcctcttcccagcttgatggtagtgatgcctcttgcacaaatcaagcagccaatgacattggggaccatcaccaaacgaaccggcaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttagaacccctcaatggaatgaattgcagccaccgtttaatgcaaaccaccctctgctcctcgctgcagatgcagtacagtattatcagttcctgcttgctggcctggttccccctggaagtcctgggcccattactcgacatgggtcttacgacagtttagcttctgaccatagtggacaggaagatgaagaatggctttcccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggatccagccagtccgctctgaccccgtcagcatgccagggtcatcccgtccagtctctgatcgaaggggagtttccacagtgattgatgctgcctcaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagacacagcccttgacgtagcagtaaaaaccttcccccctgagagacacgtggcagtgaagtgttttgaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcctgggaagagtttgtctttcttatctttaagcccctttaccctggtcctgtactgatcagtgaaggaaaccgtggttactgaggccctgttgaaaagtgcacgtcttgtccaataaatcacgctgcagttggtgtccaaaaaaaaat

SEQ ID NO: 355339 - DNA, 1886 bp, Homo sapiens
ggcatttgctgtgtttttcagcaaaacttcatcccaaatcagacatcttaaggcaccaataatttgcaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttagaacccctcaatggaatgaattgcagccaccgtttaatgcaaaccaccctctgctcctcgctgcagatgcagtacagtattatcagttcctgcttgctggcctggttccccctggaagtcctgggcccattactcgacatgggtcttacgacagtttagcttctgaccatagtggacaggaagatgaagaatggctttcccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggatccagccagtccgctctgaccccgtcagcatgccagggtcatcccgtccagtctctgatcgaaggggagtttccacagtgattgatgctgcctcaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcctgggaagagtttgtctttcttatctttaagcccctttaccctggtcctgtactgatcagtgaaggaaaccgtggttactgaggccctgttgaaaagtgcacgtcttgtccaataaatcacgctgcagttggtgtccaaaaaaaaat

SEQ ID NO: 355340 - DNA, 1176 bp, Homo sapiens
ccccaagaagtagtgagtgaaatgaagaagaaacttgtgagatgatttcaggtgaacatctttctaaatccttttattcatgacttaaaaccatttggtggctgttaaagaagcagagtgcttgacaggcctgcctgggagaaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcctgggaagagtttgtctttcttatctttaagcccctttaccctggtcctgtactgatcagtgaaggaaaccgtggttactgaggccctgttgaaaagtgcacgtcttgtccaataaatcacgctgcagttggtgtccaaaaaaaaat

SEQ ID NO: 355341 - DNA, 1279 bp, Homo sapiens
actaaggcagattttcaaagagctgtaattgtcacagggagagcacaatgacttattgaagtttcacatgttgctctttttggaactaccagagattggaaccaattctccatccacatctctatccgagagttaagttttctcttctctggtgcttgtcaaaagtatttctcccagctaatctcattcccagttgccaaagaaaagatctcaagcataactcctcatctccaggtcacccgacaaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcctgggaagagtttgtctttcttatctttaagcccctttaccctggtcctgtactgatcagtgaaggaaaccgtggttactgaggccctgttgaaaagtgcacgtcttgtccaataaatcacgctgcagttggtgtccaaaaaaaaat

SEQ ID NO: 355342 - DNA, 934 bp, Homo sapiens
aacaatgccaacagcccagcgtccgtgagcaacccaacagtaacaaagcatgcgttcgggatggaggaagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcctgggaagagtttgtctttcttatctttaagcccctttaccctggtcctgtactgatcagtgaaggaaaccgtggttactgaggccctgttgaaaagtgcacgtcttgtccaataaatcacgctgcagttggtgtccaaaaaaaaat

SEQ ID NO: 355343 - DNA, 971 bp, Homo sapiens
  misc_feature (57)..(57): n is a, c, g, or t
  misc_feature (105)..(105): n is a, c, g, or t
agacggcagccgagtcctccatggagcacacggaggagggcctccgggagcgacttnccgacgtacagttgtagctgaaagggagaaatgtggcatggcttcaanaggacagcagggttgattggtcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcctgggaagagtttgtctttcttatctttaagcccctttaccctggtcctgtactgatcagtgaaggaaaccgtggttactgaggccctgttgaaaagtgcacgtcttgtccaataaatcacgctgcagttggtgtccaaaaaaaaat

SEQ ID NO: 355344 - DNA, 388 bp, Homo sapiens
gctctttttggaactaccagagattggaaccaattctccatccacatctctatccgagagttaagttttctcttctctggtgcttgtcaaaagtatttctcccagctaatctcattcccagttgccaaagaaaagatctcaagcataactcctcatctccaggtcacccgacaaggtaagaagagagattaaatgaatgtgcccaagtttctttcccttacagcctccagatctccagaatataccttctttagtttccacatcacactttcctacatttcttcttaatttgatgatgtcttgagagtatctcaggaaactggtatgactaccaaggggacagaggcttttgtagcgcatcaatacccctaagtctatccatccttct

SEQ ID NO: 355345 - DNA, 1138 bp, Homo sapiens
ccccatgattcaattatctccacctggtccctcccaggacacatggggattatgggaactacaagtcaagatgagatttgggtggagacacagccaaacgatatcagtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcctgggaagagtttgtctttcttatctttaagcccctttaccctggtcctgtactgatcagtgaaggaaaccgtggttactgaggccctgttgaaaagtgcacgtcttgtccaataaatcacgctgcagttggtgtccaaaaaaaaat

SEQ ID NO: 355346 - DNA, 3006 bp, Homo sapiens
acctaagcaagcctgggcaatggcgggcgcccctcccccagcctcgctgccgccttgcagtttgatctcagactgctgtgctggcaatcagcgagactccgtgggcgtaggaccctccgagccaggtgtgggatatagtctcgtggtgcgccgttttttaagccggtctgaaaagcgcaatattcgggtgggagtgacccgattttccaggctgctatccatgtccagggccaaacatgaatcctattgctcttgggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaagtacaggacatctgcttcagccatgactgtcgctgggttgtggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatgggaaactgaacagccaagactcctataacaattttaccaacaacaaccctggcaaccctcggctctctcctcttcccagcttgatggtagtgatgcctcttgcacaaatcaagcagccaatgacattggggaccatcaccaaacgaaccggcaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttagaacccctcaatggaatgaattgcagccaccgtttaatgcaaaccaccctctgctcctcgctgcagatgcagtacagtattatcagttcctgcttgctggcctggttccccctggaagtcctgggcccattactcgacatgggtcttacgacagtttagcttctgaccatagtggacaggaagatgaagaatggctttcccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggatccagccagtccgctctgaccccgtcagcatgccagggtcatcccgtccagtctctgatcgaaggggagtttccacagtgattgatgctgcctcaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcctgggaagagtttgtctttcttatctttaagcccctttaccctggtcctgtactgatcagtgaaggaaaccgtggttactgaggccctgttgaaaagtgcacgtcttgtccaataaatcacgctgcagttggtgtccaaaaaaaaat

SEQ ID NO: 355347 - DNA, 3592 bp, Homo sapiens
aggaagtggctgccgtcaatcactcggggagactccaaacagtgagcctagagctggagactagcgttaaccggcggggcggccggttttatgaatgaagctatggctacagattccccaagaagacccagtcgttgtactggtggagttgtggttcgcccccaggctgtcacagagcagtcctacatggaaagtgttgtgacttttctgcaggatgttgtgccacaggcttacagtggaacacctctaacagaagaaaaggagaaaatagtctgggtcagatttgaaaatgcagatttaaatgatacatcaagaaatctggaatttcatgaaatacatagtactgggagtgaaccgcctttgttgattatgattggctacagtgatggaatgcaggtctggagcatccctatcagtggcgaagcacaagagctcttctctgttcgacatggcccaattcgagcggctagaatcttgcctgctccacagtttggtgctcaaaaatgtgataactttgctgaaaaaagacccctccttggtgtttgtaagagcattggatcttctggcacaagcccaccgtactgttgtgtggatctgtattcacttcgtactggggagatggtcaagtccattcaatttaagacacctatttatgatctccattgcaataaacggatccttgtcgtagtcttgcaggagaaaattgctgcctttgatagctgtactttcacgaagaaattctttgttacaagctgctatccatgtccagggccaaacatgaatcctattgctcttgggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaagtacaggacatctgcttcagccatgactgtcgctgggttgtggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatgggaaactgaacagccaagactcctataacaattttaccaacaacaaccctggcaaccctcggctctctcctcttcccagcttgatggtagtgatgcctcttgcacaaatcaagcagccaatgacattggggaccatcaccaaacgaaccgggccttatctctttggagcggggtgtttttccataaaagccccatgcaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttagaacccctcaatggaatgaattgcagccaccgtttaatgcaaaccaccctctgctcctcgctgcagatgcagtacagtattatcagttcctgcttgctggcctggttccccctggaagtcctgggcccattactcgacatgggtcttacgacagtttagcttctgaccatagtggacaggaagatgaagaatggctttcccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggatccagccagtccgctctgaccccgtcagcatgccagggtcatcccgtccagtctctgatcgaaggggagtttccacagtgattgatgctgcctcaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcctgggaagagtttgtctttcttatctttaagcccctttaccctggtcctgtactgatcagtgaaggaaaccgtggttactgaggccctgttgaaaagtgcacgtcttgtccaataaatcacgctgcagttggtgtccaaaaaaaaat

SEQ ID NO: 355348 - DNA, 3613 bp, Homo sapiens
aggaagtggctgccgtcaatcactcggggagactccaaacagtgagcctagagctggagactagcgttaaccggcggggcggccggttttatgaatgaagctatggctacagattccccaagaagacccagtcgttgtactggtggagttgtggttcgcccccaggctgtcacagagcagtcctacatggaaagtgttgtgacttttctgcaggatgttgtgccacaggcttacagtggaacacctctaacagaagaaaaggagaaaatagtctgggtcagatttgaaaatgcagatttaaatgatacatcaagaaatctggaatttcatgaaatacatagtactgggagtgaaccgcctttgttgattatgattggctacagtgatggaatgcaggtctggagcatccctatcagtggcgaagcacaagagctcttctctgttcgacatggcccaattcgagcggctagaatcttgcctgctccacagtttggtgctcaaaaatgtgataactttgctgaaaaaagacccctccttggtgtttgtaagagcattggatcttctggcacaagcccaccgtactgttgtgtggatctgtattcacttcgtactggggagatggtcaagtccattcaatttaagacacctatttatgatctccattgcaataaacggatccttgtcgtagtcttgcaggagaaaattgctgcctttgatagctgtactttcacgaagaaattctttgttacaagctgctatccatgtccagggccaaacatgaatcctattgctcttgggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaagtacaggacatctgcttcagccatgactgtcgctgggttgtggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatgggaaactgaacagccaagactcctataacaattttaccaacaacaaccctggcaaccctcggctctctcctcttcccagcttgatggtagtgatgcctcttgcacaaatcaagcagccaatgacattggggaccatcaccaaacgaaccggcaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttagaacccctcaatggaatgaattgcagccaccgtttaatgcaaaccaccctctgctcctcgctgcagatgcagtacagtattatcagttcctgcttgctggcctggttccccctggaagtcctgggcccattactcgacatgggtcttacgacagtttagcttctgaccatagtggacaggaagatgaagaatggctttcccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggatccagccagtccgctctgaccccgtcagcatgccagggtcatcccgtccagtctctgatcgaaggggagtttccacagtgattgatgctgcctcaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagacacagcccttgacgtagcagtaaaaaccttcccccctgagagacacgtggcagtgaagtgttttgaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcctgggaagagtttgtctttcttatctttaagcccctttaccctggtcctgtactgatcagtgaaggaaaccgtggttactgaggccctgttgaaaagtgcacgtcttgtccaataaatcacgctgcagttggtgtccaaaaaaaaat

SEQ ID NO: 355349 - DNA, 3826 bp, Homo sapiens
aggaagtggctgccgtcaatcactcggggagactccaaacagtgagcctagagctggagactagcgttaaccggcggggcggccggttttatgaatgaagctatggctacagattccccaagaagacccagtcgttgtactggtggagttgtggttcgcccccaggctgtcacagagcagtcctacatggaaagtgttgtgacttttctgcaggatgttgtgccacaggcttacagtggaacacctctaacagaagaaaaggagaaaatagtctgggtcagatttgaaaatgcagatttaaatgatacatcaagaaatctggaatttcatgaaatacatagtactgggagtgaaccgcctttgttgattatgattggctacagtgatggaatgcaggtctggagcatccctatcagtggcgaagcacaagagctcttctctgttcgacatggcccaattcgagcggctagaatcttgcctgctccacagtttggtgctcaaaaatgtgataactttgctgaaaaaagacccctccttggtgtttgtaagagcattggatcttctggcacaagcccaccgtactgttgtgtggatctgtattcacttcgtactggggagatggtcaagtccattcaatttaagacacctatttatgatctccattgcaataaacggatccttgtcgtagtcttgcaggagaaaattgctgcctttgatagctgtactttcacgaagaaattctttgttacaagctgctatccatgtccagggccaaacatgaatcctattgctcttgggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaagtacaggacatctgcttcagccatgactgtcgctgggttgtggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatgggaaactgaacagccaagactcctataacaattttaccaacaacaaccctggcaaccctcggctctctcctcttcccagcttgatggtagtgatgcctcttgcacaaatcaagcagccaatgacattggggaccatcaccaaacgaaccggcaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttagaacccctcaatggaatgaattgcagccaccgtttaatgcaaaccaccctctgctcctcgctgcagatgcagtacagtattatcagttcctgcttgctggcctggttccccctggaagtcctgggcccattactcgacatgggtcttacgacagtttagcttctgaccatagtggacaggaagatgaagaatggctttcccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggatccagccagtccgctctgaccccgtcagcatgccagggtcatcccgtccagtctctgatcgaaggggagtttccacagtgattgatgctgcctcagtggactcttccaccgcccttgagtggggaacatccaggccttcacactcacgctcagcccatcacccctctgtgcaaggtgcaaggtcctctgcccacctgaagcctcaaggcctgatggaaaccatccacagccactctaggatgagtcaacattgcatgcagccagccatggccactgggagaagagtcagacatgggccatggagctgcaggctcacctgcccccggctgagtcaggaccgagcacaggacttgacagaggaggcatcgcagcaaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcctgggaagagtttgtctttcttatctttaagcccctttaccctggtcctgtactgatcagtgaaggaaaccgtggttactgaggccctgttgaaaagtgcacgtcttgtccaataaatcacgctgcagttggtgtccaaaaaaaaat

SEQ ID NO: 355350 - DNA, 1336 bp, Homo sapiens
ctgtggtattgttatagcagcagaaaatgaactaagatagcattcttcataatcttctagttccttatgagttagtatccacaaatgatggataagatacctgttcattcataagcatgttctgtgtaccccagcatggtattcatttcccgattggaccactttcctggtccgttatggaaaggtgaacaaacaaacaaaccccacatggacattcagattgaacagtgatgatccttagttggttctccatgcaggtggctgttaaagaagcagagtgcttgacaggcctgcctgggagaaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcctgggaagagtttgtctttcttatctttaagcccctttaccctggtcctgtactgatcagtgaaggaaaccgtggttactgaggccctgttgaaaagtgcacgtcttgtccaataaatcacgctgcagttggtgtccaaaaaaaaat

SEQ ID NO: 355351 - DNA, 535 bp, Homo sapiens
aacttcggagctgtcgcccgggttaccgggaggcggagccgccgagctcgctgtggcccggatgttcggtgcagctgccagatccgctgatctagtgcttctcgaaaaaaaccttcaggcggcccatgggtgagtggtcgccaagatcccgggaagcgtttctggtagtcccgactactttcctacacggctggcctcgggctcggctctttgtaggcggccttcggttggcggcgcaggctcgccccttgaccccgcccgccctcgggccgggctccgcactcctgcggggttggggtggtctgtccgcaacgggctactaggggaggcgcgctgtctgcggcgaaatgccaggtctttgttgtttggtccgaaatgtctcttcagtcccttagtttaatgtcgagggaacacttgcttgagggttgacttcggaattgaaaacgcgggtgatagtgcagaaaaaacagtaaagcagaagcaagttgctgcataatttgtctactgcttcaacctcaaacgtagatttatagcg

SEQ ID NO: 355352 - DNA, 1730 bp, Homo sapiens
aacttcggagctgtcgcccgggttaccgggaggcggagccgccgagctcgctgtggcccggatgttcggtgcagctgccagatccgctgatctagtgcttctcgaaaaaaaccttcaggcggcccatggatgttactatactggcatttgtttttaaaaagctgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacgtacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacataaaa

SEQ ID NO: 355353 - DNA, 1897 bp, Homo sapiens
gtcattgttcatgttggcattttgatgtctatattattttttaaaacatttaataattttataataatttctaatttatgatttggtaccgtgtcttgtacagtaagttgaacatcatgaatccagaacatttatctgcagttattcttatataatgttaataactaggtttttcattgaatgttagtcaactattttagtaacttagtaaaaggaatcttctaagagcattgtacaaatatagcacatacaatatagatttctttttattttacttatgccctcttttttatttctaaaagctgcacatgtaaacttaaatatttaaactgaaatgggatgtcttatagaatgatttgggggggtgttaatgttgtaaaataatatctgtacacaaaatattggttttatatattataggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacgtacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacataaaa

SEQ ID NO: 355354 - DNA, 1657 bp, Homo sapiens
aacttcggagctgtcgcccgggttaccgggaggcggagccgccgagctcgctgtggcccggatgttcggtgcagctgccagatccgctgatctagtgcttctcgaaaaaaaccttcaggcggcccatggctgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagaggcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacgtacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacataaaa

SEQ ID NO: 355355 - DNA, 1561 bp, Homo sapiens
aacttcggagctgtcgcccgggttaccgggaggcggagccgccgagctcgctgtggcccggatgttcggtgcagctgccagatccgctgatctagtgcttctcgaaaaaaaccttcaggcggcccatggctgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacgtacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacataaaa

SEQ ID NO: 355356 - DNA, 668 bp, Homo sapiens
  misc_feature (668)..(668): n is a, c, g, or t
aacttcggagctgtcgcccgggttaccgggaggcggagccgccgagctcgctgtggcccggatgttcggtgcagctgccagatccgctgatctagtgcttctcgaaaaaaaccttcaggcggcccatggctgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagaggcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatgtaccatcgattttatcctatcatcatcctggtcgctcttacatctgcgtgcccaacctgtcctcggcgacaaacttccatggcgatctggtaaattactgcgcctaacccaatctttcaaacn

SEQ ID NO: 355357 - DNA, 767 bp, Homo sapiens
attatattagtgttatctttggttactctggctgtgtacatgtctgcttctgaaatagaggtaggaagtctttttttcctttgttaaagactttttgataaatttgacaattcaatatcagaatagtccatatgatatgatatagtacaactaattgttttagtaatctttggctgattgatgccacttggtagcttttggcttgttaactttatgaaaagttgtgtactggactatatatttccctgggaaattagcaaaatagtgaagtagtcaggcccaactatccagcatgaaggagaaatgtcatttcacataattttcccatgtagcaaacatataattattgaaatgttgaaacttattaacagtattttgagaaaaaccataaaaatgttttatatttagaactaattttaaactttattttacaatggcaacattaatagtcatcagtaattgtgcattccatatccttctgtgttttatcacaaattttattttcctgattatggatgtttacttttaccccataatgtttgggggatttggagctaacattaatagccacattattctgatactgttactttttcacagtattcattttgtacctctaatattttaatatttcagtggaaggccactattataaagaactccttttaaaaaattgtgtatgtctttattttcagaatatttttggccaaaaaagtatcttttgacacatttgtagtcactgggtagaatagaacatcatatcataa

SEQ ID NO: 355358 - DNA, 1680 bp, Homo sapiens
aacttcggagctgtcgcccgggttaccgggaggcggagccgccgagctcgctgtggcccggatgttcggtgcagctgccagatccgctgatctagtgcttctcgaaaaaaaccttcaggcggcccatggcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacgtacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacataaaa

SEQ ID NO: 355359 - DNA, 1698 bp, Homo sapiens
aacttcggagctgtcgcccgggttaccgggaggcggagccgccgagctcgctgtggcccggatgttcggtgcagctgccagatccgctgatctagtgcttctcgaaaaaaaccttcaggcggcccatggctgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacgtacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacataaaa

SEQ ID NO: 355360 - DNA, 2179 bp, Homo sapiens
aacttcggagctgtcgcccgggttaccgggaggcggagccgccgagctcgctgtggcccggatgttcggtgcagctgccagatccgctgatctagtgcttctcgaaaaaaaccttcaggcggcccatggctgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacgtacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacataaaaaaaaaaaaaaaaaaaaaaaaaaaaaaaaaaaaaaaaaaaaaaaaaaaaaaaaaaaacaaaaaaaaaagaacgacaaagaaaacaaaaaaaaagaaaaaaaaaaaacaacgacaagaaaccgacaagcaaacaaaaaaagaacacaaagaagagaacaacagcggactactgcaccacagagcacgcggagcgacagtcacgagcgaaaacgcacatgcaagatcacgagaaagacaataacgaacacgcagccgacacgacaaaccaaggcagacgcacaccaacagccaccaggagaaagaaacgaagcaaagacgggacggccactcaccacacaagagagaaagagagggcaggagagagaagaaaccgacaatagacaaatatgccgcctcacatcccagcccaaaagacacacgccacagcactaaaaccgagaagggcacgaaaagacataaatagaagagagcaacaagacaaa

SEQ ID NO: 355361 - DNA, 2355 bp, Homo sapiens
aacttcggagctgtcgcccgggttaccgggaggcggagccgccgagctcgctgtggcccggatgttcggtgcagctgccagatccgctgatctagtgcttctcgaaaaaaaccttcaggcggcccatggctgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacgtacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacataaaatttcaatgttttgacacttaattgttgtttggcacaatagtatggaagtaattcaaactggtaaatagtttcctctcatatctcgggtatatatacataccatattttattgatccagagatacttatttcactttgtgacatctctgaattaggatgcatcttacaactgatggcttattaggtttaatgaaatacagaagatacacagtataaaaagggttttcctgtggttggtttgtggtttgtgataggtgttctgtgatgtttatgctttgaaggccttaagactcatggttgcaaccatggaagcaaaatgaaatttttagctcttaacctaacaacctgaccatgtttatccatttttattgtttagaagtttatttactgatacttggtggaggttgtgtgaattagttaaattttaaatgtttaagacttctattaacagctgcaaaatatgaaagtaagtgcactcacttttcctgtagtagtctgtcttttgaattcacagcagttgtatccttgagttactttgttaatgtatttttctcagtacatttaaccactgggaaatgaacccttgtacgaatgtgtttcttcttctctgtaggaataaaaaataaatataaaaattttatttgtattgcacacattt

SEQ ID NO: 355362 - DNA, 1614 bp, Homo sapiens
tgaaaggagaaattcaacagtcgcttggagcctgggttttgcttactgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacgtacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacataaaa

SEQ ID NO: 355363 - DNA, 1606 bp, Homo sapiens
aacttcggagctgtcgcccgggttaccgggaggcggagccgccgagctcgctgtggcccggatgttcggtgcagctgccagatccgctgatctagtgcttctcgaaaaaaaccttcaggcggcccatgggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacgtacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacataaaa

SEQ ID NO: 355364 - DNA, 1057 bp, Homo sapiens
aacttcggagctgtcgcccgggttaccgggaggcggagccgccgagctcgctgtggcccggatgttcggtgcagctgccagatccgctgatctagtgcttctcgaaaaaaaccttcaggcggcccatggctgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatatttacggctttccatacatttatatttagtgtgatcttgtggttactcctgggtgtgtaccaatgttctgttttctggagatagagaacgttattgaatctcttgggtcggaaagaaaaagatttattgtctctttaaccagggttacttaaggcctatgggaataattccattcagagggtaaattggacaaatttggcccttgtggtttggacactaacagccttttattgtgcgggaattcggactcaggtatctcaaggccgggtgggttttgtaaggaagaaggta

SEQ ID NO: 355365 - DNA, 469 bp, Homo sapiens
gcctggcccctgagagccacacctagaggagggcctagtttgaggaggtgcccagtcctgaggacacaggtcccccgcactgcacaaggacagagcctgagggcttcttcacggtccaggggcctcggataaatgtccagggttcagccttacccagggcttcatgtgagggcatccacagctcgggcaactgcctcgttcagacctggcccatgtccaggtgggcatggccaacatttcagagcactcagcttacagacctccttttgccaacagtgcctccgtttccctcctcagatcaccagtgccccactgcgtgtgagcctggggaaccaaacctcttccctgacctcagccctggggtgctattaggcatgcatgaggggcagagccctgccctggccggagcttggggtcctggcctggaacatctccctgaagcaccctctgccctggccggagctcaggg

SEQ ID NO: 355366 - DNA, 466 bp, Homo sapiens
  misc_feature (421)..(421): n is a, c, g, or t
ttctgagccaaggtcccacgccacatggccgggcacagcagtgccaagatgttccctccgggtcctcggtgttctgatcccagaaggacatgctcctcccctagcctgctgtgaagggcttatgtgttcctctacctcagaatccccttagttggactccttgggcctcaccagaaagacctctatcctttgccaactcctgactttggcaccttgcatttggtgactgtctagcacaggaggttaggtaggcagagatcctgactggtaggcctgaggccgctctgcctgtggcctgacatgctctctgtcctgctctagatcaatggcattgcactggacaacaagtctctgaatgaatgtgaatctctgctgcggagctgccaggactccctgaccctgtccctcctgaagtcccggntgacctattcacctccaaccgcatcacccgttcgggtacggagct

SEQ ID NO: 355367 - DNA, 5993 bp, Homo sapiens
gagatggaggcgctgcggcagatcaaagacacggtgacaatggatgctgggagagccaacaaggaggttgaaatccttcgaaagcagtgcaaggctctgtgccaggagctgaaggaagccctccaggaggcggatgtggccaagtgccggcgggactgggccttccaggagcgagacaagattgtagcagagcgtgacagcatccggacactgtgtgacaacctgaggcgggagcgggaccgtgcggtgagcgagctggctgaggccctgcgcagcctggatgacacccgcaagcagaagaatgatgtcagccgcgagctgaaggagctcaaggaacagatggaatcccagttggaaaaggaggcccggttccgacagctgatggcccacagctcccacgactcggccattgacacggattccatggagtgggaaacggaagttgtagagttcgagagggagacggaggatattgacttgaaggcactggggtttgatatggcagaaggtgtgaatgagccttgtttcccgggggactgtggcatatttgtcactaaagtggacaaaggaagcattgctgatggccgcttaagggtcaatgactggctgctgagaatcaacgatgtggacctcatcaacaaggacaagaagcaggccatcaaggcgctcctcaatggggagggggccatcaacatggtcgtgcggcggaggaagtccctgggtgggaaggtggtcacgccgctgcacatcaacctcagtggacagaaagacagtggcatcagtctggagaatggagtgtatgctgccgctgtgctgcctggaagccctgccgctaaagaagggtcccttgctgtgggagacaggatcgttgcgatcaatggcattgcactggacaacaagtctctgaatgaatgtgaatctctgctgcggagctgccaggactccctgaccctgtccctcctgaaggtattccctcagagctcctcgtggagtggccagaacatttttgaaaatatcaaagactctgataagatgctgagttttcgagcccatggcccggaggtccaggctcataacaaacggaacttgatacagcacaataactccacgcagacagacatcttctacacggacaggctggaagacaggaaggagccaggccccccaggaggcagcagctcctttctgcataagccattccctgggggacccttgcaggtctgcccccaggcctgtcccagtgcctctgagcgtagcctgagctccttccgctcagatgcctctggggaccgtggctttgggctggtggacgtgcgtggccggcggccactgctgccctttgagaccgaggtgggcccctgtggggttggggaggcctccctggacaaggcagactctgaaggctccaacagcggcgggacctggcccaaggccatgctcagctccacggcagtgcctgagaagctctctgtttataaaaagccaaagcaaagaaagtccatctttgaccctaacactttcaaacgcccccagacaccccccaaaatagactacctgcttccaggtcctgggcctgctcactctccccagccctccaagagggcggggcctctgacacccccaaaacctcccagaaggagcgactccattaagttccagcacaggctggagactagctccgagtcagaagccactctggtgggcagctccccatccactagtcccccgagcgccctgccccctgacgtggaccccggggagcccatgcacgcatcaccccctcgcaaggccagggtccgcattgcttccagctactaccctgaaggagatggggactcctcccacctgccggccaagaaatcctgtgatgaggacctcacctcccagaaggtggatgagctggggcagaagcgtcgccggccaaaatctgctcccagttttcggccgaagcttgctccagtagtgattcctgctcagttcctggaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctaggagaatgctgtgctgtggatgactgcagctggccgcctgaggggacgccagactcagctcttttctagcgactgaaagtagaagtctgtccgtctatgaacatgcgggggaaggatccggaaccaggacccagaagcacctcctttgtagacagagggccacggctgcgtgcgatccaggcccaggcccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttggtggcacctctcctggaaggacgtcacaactccaggtgctcagactgcctgtggcagcagaaccagtgcctttggcattttcctcccacaatggggaaggtgactttggcattcttacaaactcgtctctcggcctttctctcctgccttccacagcctctcgtttctcctccatctgtgcttattacttgaggactgtgtctgctccgtgagagctgcgtgggcagggctgcagtggggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggcttttttttttttggcacttctgaggctagatatgtctggctgaagatttgatgtggttcctccttaagctatgcgtcctgttaataataggtactgtactgggctctgtgtaagtgtcgttggggtaggacctatattttaatactgttcctaacatttcattttactagcgagaaatctttgatttcattttattctttgtaattctagacactagattgtagtttagccataactgatgttttttaaaaagggatatattttcttgcacagttgttcaaaaaagagacaagtttcagtcctcaatgctgtcctttgttttacaggtacaagttttctagctcagacaaactatgaaaaactgtagactattctcaaggtattaactcgcagaccctctgggggtaggggctgttttctaagttacaggcagagtgggactgagatggtacagtgtgcacagacaggtactgagctgacagactgggattttctgtactaaaatgttactttgtatcaaaagttaaacaggctttagtacaacaaataaaggtcaatttctgtaa

SEQ ID NO: 355368 - DNA, 4074 bp, Homo sapiens
tagcagacactcttgcccttgcatctgcaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctaggagaatgctgtgctgtggatgactgcagctggccgcctgaggggacgccagactcagctcttttctagcgactgaaagtagaagtctgtccgtctatgaacatgcgggggaaggatccggaaccaggacccagaagcacctcctttgtagacagagggccacggctgcgtgcgatccaggcccaggcccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttggtggcacctctcctggaaggacgtcacaactccaggtgctcagactgcctgtggcagcagaaccagtgcctttggcattttcctcccacaatggggaaggtgactttggcattcttacaaactcgtctctcggcctttctctcctgccttccacagcctctcgtttctcctccatctgtgcttattacttgaggactgtgtctgctccgtgagagctgcgtgggcagggctgcagtggggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggcttttttttttttggcacttctgaggctagatatgtctggctgaagatttgatgtggttcctccttaagctatgcgtcctgttaataataggtactgtactgggctctgtgtaagtgtcgttggggtaggacctatattttaatactgttcctaacatttcattttactagcgagaaatctttgatttcattttattctttgtaattctagacactagattgtagtttagccataactgatgttttttaaaaagggatatattttcttgcacagttgttcaaaaaagagacaagtttcagtcctcaatgctgtcctttgttttacaggtacaagttttctagctcagacaaactatgaaaaactgtagactattctcaaggtattaactcgcagaccctctgggggtaggggctgttttctaagttacaggcagagtgggactgagatggtacagtgtgcacagacaggtactgagctgacagactgggattttctgtactaaaatgttactttgtatcaaaagttaaacaggctttagtacaacaaataaaggtcaatttctgtaaaaaaaaaaaacaaatttttaaaccaaaacaaaaaagg

SEQ ID NO: 355369 - DNA, 4514 bp, Homo sapiens
  misc_feature (4050)..(4050): n is a, c, g, or t
tagcagacactcttgcccttgcatctgcaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctaggagaatgctgtgctgtggatgactgcagctggccgcctgaggggacgccagactcagctcttttctagcgactgaaagtagaagtctgtccgtctatgaacatgcgggggaaggatccggaaccaggacccagaagcacctcctttgtagacagagggccacggctgcgtgcgatccaggcccaggcccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttggtggcacctctcctggaaggacgtcacaactccaggtgctcagactgcctgtggcagcagaaccagtgcctttggcattttcctcccacaatggggaaggtgactttggcattcttacaaactcgtctctcggcctttctctcctgccttccacagcctctcgtttctcctccatctgtgcttattacttgaggactgtgtctgctccgtgagagctgcgtgggcagggctgcagtggggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggcttttttttttttggcacttctgaggctagatatgtctggctgaagatttgatgtggttcctccttaagctatgcgtcctgttaataataggtactgtactgggctctgtgtaagtgtcgttggggtaggacctatattttaatactgttcctaacatttcattttactagcgagaaatctttgatttcattttattctttgtaattctagacactagattgtagtttagccataactgatgttttttaaaaagggatatattttcttgcacagttgttcaaaaaagagacaagtttcagtcctcaatgctgtcctttgttttacaggtacaagttttctagctcagacaaactatgaaaaactgtagactattctcaaggtattaactcgcagaccctctgggggtaggggctgttttctaagttacaggcagagtgggactgagatggtacagtgtgcacagacaggtactgagctgacagactgggattttctgtactaaaatgttactttgtatcaaaagttaaacaggctttagtacaacaaataaaggtcaatttctgtaaaaaaaaaaaaaanaaaaaaaaaaaaaaaaaaaaaaaaaaaaaaaaaaaaaaaaagaacacaacaagaaccgaaaaaaaacaaacagcaaagcaccagaaaaggacgacagggaagaccacgacaacacagcaacacggcggcgcctcaaacagacacccgcacctcctctgccacccacgccatgcgcctgagcacatgaactaccaaacacccgaatcacacaaaaaaaccatgcgcacgcggtgcacccaacgggcgcagagtggcccccccatcaggcgccgggcacaccatccaaggccaacgcacaacacccgcgggacacgccaccacaagcaaagcaacacacagaagagagagaaacgcaggcgcccgcgaatacgaacagcaccacggccaacatgagcagccacaggacaacaccagcgccaaaatacactggcagatcaaaccaaacatcacaacccaccgcgaac

SEQ ID NO: 355370 - DNA, 4973 bp, Homo sapiens
gagatggaggcgctgcggcagatcaaagacacggtgacaatggatgctgggagagccaacaaggaggttgaaatccttcgaaagcagtgcaaggctctgtgccaggagctgaaggaagccctccaggaggcggatgtggccaagtgccggcgggactgggccttccaggagcgagacaagattgtagcagagcgtgacagcatccggacactgtgtgacaacctgaggcgggagcgggaccgtgcggtgagcgagctggctgaggccctgcgcagcctggatgacacccgcaagcagaagaatgatgtcagccgcgagctgaaggagctcaaggaacagatggaatcccagttggaaaaggaggcccggttccgacagctgatggcccacagctcccacgactcggccattgacacggattccatggagtgggaaacggaagttgtagagttcgagagggagacggaggatattgacttgaaggcactggggtttgatatggcagaaggtgtgaatgagccttgtttcccgggggactgtggcatatttgtcactaaagtggacaaaggaagcattgctgatggccgcttaagggtcaatgactggctgctgagaatcaacgatgtggacctcatcaacaaggacaagaagcaggccatcaaggcgctcctcaatggggagggggccatcaacatggtcgtgcggcggaggaagtccctgggtgggaaggtggtcacgccgctgcacatcaacctcagtggacagaaagacagtggcatcagtctggagaatggagtgtatgctgccgctgtgctgcctggaagccctgccgctaaagaagggtcccttgctgtgggagacaggatcgttgcgatcaatggcattgcactggacaacaagtctctgaatgaatgtgaatctctgctgcggagctgccaggactccctgaccctgtccctcctgaaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctaggagaatgctgtgctgtggatgactgcagctggccgcctgaggggacgccagactcagctcttttctagcgactgaaagtagaagtctgtccgtctatgaacatgcgggggaaggatccggaaccaggacccagaagcacctcctttgtagacagagggccacggctgcgtgcgatccaggcccaggcccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttggtggcacctctcctggaaggacgtcacaactccaggtgctcagactgcctgtggcagcagaaccagtgcctttggcattttcctcccacaatggggaaggtgactttggcattcttacaaactcgtctctcggcctttctctcctgccttccacagcctctcgtttctcctccatctgtgcttattacttgaggactgtgtctgctccgtgagagctgcgtgggcagggctgcagtggggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggcttttttttttttggcacttctgaggctagatatgtctggctgaagatttgatgtggttcctccttaagctatgcgtcctgttaataataggtactgtactgggctctgtgtaagtgtcgttggggtaggacctatattttaatactgttcctaacatttcattttactagcgagaaatctttgatttcattttattctttgtaattctagacactagattgtagtttagccataactgatgttttttaaaaagggatatattttcttgcacagttgttcaaaaaagagacaagtttcagtcctcaatgctgtcctttgttttacaggtacaagttttctagctcagacaaactatgaaaaactgtagactattctcaaggtattaactcgcagaccctctgggggtaggggctgttttctaagttacaggcagagtgggactgagatggtacagtgtgcacagacaggtactgagctgacagactgggattttctgtactaaaatgttactttgtatcaaaagttaaacaggctttagtacaacaaataaaggtcaatttctgtaa

SEQ ID NO: 355371 - DNA, 2933 bp, Homo sapiens
  misc_feature (94)..(94): n is a, c, g, or t
  misc_feature (107)..(107): n is a, c, g, or t
acgcaacagaaatccaatctagagctgctccgcatctccctgctgctcatcgagtcgtggctggagcccgtgcggttcctcaggagtatgttcnccaacaacctgtntatgacacctcggacagcgatgactatcacctcctaaaggacctagaggaaggcatccaaacgctatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctaggagaatgctgtgctgtggatgactgcagctggccgcctgaggggacgccagactcagctcttttctagcgactgaaagtagaagtctgtccgtctatgaacatgcgggggaaggatccggaaccaggacccagaagcacctcctttgtagacagagggccacggctgcgtgcgatccaggcccaggcccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttggtggcacctctcctggaaggacgtcacaactccaggtgctcagactgcctgtggcagcagaaccagtgcctttggcattttcctcccacaatggggaaggtgactttggcattcttacaaactcgtctctcggcctttctctcctgccttccacagcctctcgtttctcctccatctgtgcttattacttgaggactgtgtctgctccgtgagagctgcgtgggcagggctgcagtggggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggcttttttttttttggcacttctgaggctagatatgtctggctgaagatttgatgtggttcctccttaagctatgcgtcctgttaataataggtactgtactgggctctgtgtaagtgtcgttggggtaggacctatattttaatactgttcctaacatttcattttactagcgagaaatctttgatttcattttattctttgtaattctagacactagattgtagtttagccataactgatgttttttaaaaagggatatattttcttgcacagttgttcaaaaaagagacaagtttcagtcctcaatgctgtcctttgttttacaggtacaagttttctagctcagacaaactatgaaaaactgtagactattctcaaggtattaactcgcagaccctctgggggtaggggctgttttctaagttacaggcagagtgggactgagatggtacagtgtgcacagacaggtactgagctgacagactgggattttctgtactaaaatgttactttgtatcaaaagttaaacaggctttagtacaacaaataaaggtcaatttctgtaa

SEQ ID NO: 355372 - DNA, 2414 bp, Homo sapiens
acttagaggatccgctgatcgcttaggctgatcggctgatcgcttaactgcttagtcagccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctaggagaatgctgtgctgtggatgactgcagctggccgcctgaggggacgccagactcagctcttttctagcgactgaaagtagaagtctgtccgtctatgaacatgcgggggaaggatccggaaccaggacccagaagcacctcctttgtagacagagggccacggctgcgtgcgatccaggcccaggcccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttggtggcacctctcctggaaggacgtcacaactccaggtgctcagactgcctgtggcagcagaaccagtgcctttggcattttcctcccacaatggggaaggtgactttggcattcttacaaactcgtctctcggcctttctctcctgccttccacagcctctcgtttctcctccatctgtgcttattacttgaggactgtgtctgctccgtgagagctgcgtgggcagggctgcagtggggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggcttttttttttttggcacttctgaggctagatatgtctggctgaagatttgatgtggttcctccttaagctatgcgtcctgttaataataggtactgtactgggctctgtgtaagtgtcgttggggtaggacctatattttaatactgttcctaacatttcattttactagcgagaaatctttgatttcattttattctttgtaattctagacactagattgtagtttagccataactgatgttttttaaaaagggatatattttcttgcacagttgttcaaaaaagagacaagtttcagtcctcaatgctgtcctttgttttacaggtacaagttttctagctcagacaaactatgaaaaactgtagactattctcaaggtattaactcgcagaccctctgggggtaggggctgttttctaagttacaggcagagtgggactgagatggtacagtgtgcacagacaggtactgagctgacagactgggattttctgtactaaaatgttactttgtatcaaaagttaaacaggctttagtacaacaaataaaggtcaatttctgtaa

SEQ ID NO: 355373 - DNA, 3068 bp, Homo sapiens
gagatggaggcgctgcggcagatcaaagacacggtgacaatggatgctgggagagccaacaaggaggttgaaatccttcgaaagcagtgcaaggctctgtgccaggagctgaaggaagccctccaggaggcggatgtggccaagtgccggcgggactgggccttccaggagcgagacaagattgtagcagagcgtgacagcatccggacactgtgtgacaacctgaggcgggagcgggaccgtgcggtgagcgagctggctgaggccctgcgcagcctggatgacacccgcaagcagaagaatgatgtcagccgcgagctgaaggagctcaaggaacagatggaatcccagttggaaaaggaggcccggttccgacagctgatggcccacagctcccacgactcggccattgacacggattccatggagtgggaaacggaagttgtagagttcgagagggagacggaggatattgacttgaaggcactggggtttgatatggcagaaggtgtgaatgagccttgtttcccgggggactgtggcatatttgtcactaaagtggacaaaggaagcattgctgatggccgcttaagggtcaatgactggctgctgagaatcaacgatgtggacctcatcaacaaggacaagaagcaggccatcaaggcgctcctcaatggggagggggccatcaacatggtcgtgcggcggaggaagtccctgggtgggaaggtggtcacgccgctgcacatcaacctcagtggacagaaagacagtggcatcagtctggagaatggagtgtatgctgccgctgtgctgcctggaagccctgccgctaaagaagggtcccttgctgtgggagacaggatcgttgcgatcaatggcattgcactggacaacaagtctctgaatgaatgtgaatctctgctgcggagctgccaggactccctgaccctgtccctcctgaaggtattccctcagagctcctcgtggagtggccagaacatttttgaaaatatcaaagactctgataagatgctgagttttcgagcccatggcccggaggtccaggctcataacaaacggaacttgatacagcacaataactccacgcagacagacatcttctacacggacaggctggaagacaggaaggagccaggccccccaggaggcagcagctcctttctgcataagccattccctgggggacccttgcaggtctgcccccaggcctgtcccagtgcctctgagcgtagcctgaagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctaggagaatgctgtgctgtggatgactgcagctggccgcctgaggggacgccagactcagctcttttctagcgactgaaagtagaagtctgtccgtctatgaacatgcgggggaaggatccggaaccaggacccagaagcacctcctttgtagacagagggccacggctgcgtgcgatccaggcccaggcccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttggtggcacctctcctggaaggacgtcacaactccaggtgctcagactgcctgtggcagcagaaccagtgcctttggcattttcctcccacaatggggaaggtgactttggcattcttacaaactcgtctctcggcctttctctcctgccttccacagcctctcgtttctcctccatctgtgcttattacttgaggactgtgtctgctccgtgagagctgcgtgggcagggctgcagtggggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggcttttttttttttggcacttctgaggctagatatgtctggctgaagatttgatgtggttcctccttaagctatgcgtcctgttaataataggtactgtactgggctctgtgtaagtgtcgttggggtaggacctatattttaatactgttcctaacatttcattttactagcgagaaatctttgatttcattttattctttgtaattctagacactagattgtagtttagccataactgatgttttttaaaaagggatatattttcttgcacagttgttcaaaaaagagacaagtttcagtcctcaatgctgtcctttgttttacaggtacaagttttctagctcagacaaactatgaaaaactgtagactattctcaaggtattaactcgcagaccctctgggggtaggggctgttttctaagttacaggcagagtgggactgagatggtacagtgtgcacagacaggtactgagctgacagactgggattttctgtactaaaatgttactttgtatcaaaagttaaacaggctttagtacaacaaataaaggtcaatttctgtaa

SEQ ID NO: 355374 - DNA, 4211 bp, Homo sapiens
  misc_feature (3747)..(3747): n is a, c, g, or t
tagcagacactcttgcccttgcatctgcaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctaggagaatgctgtgctgtggatgactgcagctggccgcctgaggggacgccagactcagctcttttctagcgactgaaagtagaagtctgtccgtctatgaacatgcgggggaaggatccggaaccaggacccagaagcacctcctttgtagacagagggccacggctgcgtgcgatccaggcccaggcccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttggtggcacctctcctggaaggacgtcacaactccaggtgctcagactgcctgtggcagcagaaccagtgcctttggcattttcctcccacaatggggaaggtgactttggcattcttacaaactcgtctctcggcctttctctcctgccttccacagcctctcgtttctcctccatctgtgcttattacttgaggactgtgtctgctccgtgagagctgcgtgggcagggctgcagtggggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggcttttttttttttggcacttctgaggcattgaggcagccagcgcaggggcttctgctgagggggcaggcggagcttgaggaaaccgcagataagttttttctctcttggaaagatagagattaatacaactacttaaaaaatatagtcaataggttactaaaatatggctaaggcgtaaagtttttaaaccgcgtaatttaaatagcctaagaattttaacgagaaacacttttgacagacttagaaagagttagcatgtgaggaaaaaaaaaaaanaaaaaaaaaaaaaaaaaaaaaaaaaaaaaaaaaaaaaaaaagaacacaacaagaaccgaaaaaaaacaaacagcaaagcaccagaaaaggacgacagggaagaccacgacaacacagcaacacggcggcgcctcaaacagacacccgcacctcctctgccacccacgccatgcgcctgagcacatgaactaccaaacacccgaatcacacaaaaaaaccatgcgcacgcggtgcacccaacgggcgcagagtggcccccccatcaggcgccgggcacaccatccaaggccaacgcacaacacccgcgggacacgccaccacaagcaaagcaacacacagaagagagagaaacgcaggcgcccgcgaatacgaacagcaccacggccaacatgagcagccacaggacaacaccagcgccaaaatacactggcagatcaaaccaaacatcacaacccaccgcgaac

SEQ ID NO: 355375 - DNA, 1781 bp, Homo sapiens
  misc_feature (66)..(66): n is a, c, g, or t
  misc_feature (68)..(68): n is a, c, g, or t
  misc_feature (91)..(91): n is a, c, g, or t
cccctcctcagcagacgcagctcttccctccagggatgggacaggatgattttatgatcacgagtntnggggccttgccatctatcaagtncaaaagaccagtataagagatctcagtgctcaggtacgccagtgctcagccttttcaagaaaatcttatactttctcctttctcctcagcagactcagctcttttctagcgactgaaagtagaagtctgtccgtctatgaacatgcgggggaaggatccggaaccaggacccagaagcacctcctttgtagacagagggccacggctgcgtgcgatccaggcccaggcccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttggtggcacctctcctggaaggacgtcacaactccaggtgctcagactgcctgtggcagcagaaccagtgcctttggcattttcctcccacaatggggaaggtgactttggcattcttacaaactcgtctctcggcctttctctcctgccttccacagcctctcgtttctcctccatctgtgcttattacttgaggactgtgtctgctccgtgagagctgcgtgggcagggctgcagtggggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggcttttttttttttggcacttctgaggctagatatgtctggctgaagatttgatgtggttcctccttaagctatgcgtcctgttaataataggtactgtactgggctctgtgtaagtgtcgttggggtaggacctatattttaatactgttcctaacatttcattttactagcgagaaatctttgatttcattttattctttgtaattctagacactagattgtagtttagccataactgatgttttttaaaaagggatatattttcttgcacagttgttcaaaaaagagacaagtttcagtcctcaatgctgtcctttgttttacaggtacaagttttctagctcagacaaactatgaaaaactgtagactattctcaaggtattaactcgcagaccctctgggggtaggggctgttttctaagttacaggcagagtgggactgagatggtacagtgtgcacagacaggtactgagctgacagactgggattttctgtactaaaatgttactttgtatcaaaagttaaacaggctttagtacaacaaataaaggtcaatttctgtaa

SEQ ID NO: 355376 - DNA, 4911 bp, Homo sapiens
  misc_feature (4895)..(4896): n is a, c, g, or t
gagatggaggcgctgcggcagatcaaagacacggtgacaatggatgctgggagagccaacaaggaggttgaaatccttcgaaagcagtgcaaggctctgtgccaggagctgaaggaagccctccaggaggcggatgtggccaagtgccggcgggactgggccttccaggagcgagacaagattgtagcagagcgtgacagcatccggacactgtgtgacaacctgaggcgggagcgggaccgtgcggtgagcgagctggctgaggccctgcgcagcctggatgacacccgcaagcagaagaatgatgtcagccgcgagctgaaggagctcaaggaacagatggaatcccagttggaaaaggaggcccggttccgacagctgatggcccacagctcccacgactcggccattgacacggattccatggagtgggaaacggaagttgtagagttcgagagggagacggaggatattgacttgaaggcactggggtttgatatggcagaaggtgtgaatgagccttgtttcccgggggactgtggcatatttgtcactaaagtggacaaaggaagcattgctgatggccgcttaagggtcaatgactggctgctgagaatcaacgatgtggacctcatcaacaaggacaagaagcaggccatcaaggcgctcctcaatggggagggggccatcaacatggtcgtgcggcggaggaagtccctgggtgggaaggtggtcacgccgctgcacatcaacctcagtggacagaaagacagtggcatcagtctggagaatggagtgtatgctgccgctgtgctgcctggaagccctgccgctaaagaagggtcccttgctgtgggagacaggatcgttgcgatcaatggcattgcactggacaacaagtctctgaatgaatgtgaatctctgctgcggagctgccaggactccctgaccctgtccctcctgaaggtattccctcagagctcctcgtggagtggccagaacatttttgaaaatatcaaagactctgataagatgctgagttttcgagcccatggcccggaggtccaggctcataacaaacggaacttgatacagcacaataactccacgcagacagacatcttctacacggacaggctggaagacaggaaggagccaggccccccaggaggcagcagctcctttctgcataagccattccctgggggacccttgcaggtctgcccccaggcctgtcccagtgcctctgagcgtagcctgagctccttccgctcagatgcctctggggaccgtggctttgggctggtggacgtgcgtggccggcggccactgctgccctttgagaccgaggtgggcccctgtggggttggggaggcctccctggacaaggcagactctgaaggctccaacagcggcgggacctggcccaaggccatgctcagctccacggcagtgcctgagaagctctctgtttataaaaagccaaagcaaagaaagtccatctttgaccctaacactttcaaacgcccccagacaccccccaaaatagactacctgcttccaggtcctgggcctgctcactctccccagccctccaagagggcggggcctctgacacccccaaaacctcccagaaggagcgactccattaagttccagcacaggctggagactagctccgagtcagaagccactctggtgggcagctccccatccactagtcccccgagcgccctgccccctgacgtggaccccggggagcccatgcacgcatcaccccctcgcaaggccagggtccgcattgcttccagctactaccctgaaggagatggggactcctcccacctgccggccaagaaatcctgtgatgaggacctcacctcccagaaggtggatgagctggggcagaagcgtcgccggccaaaatctgctcccagttttcggccgaagcttgctccagtagtgattcctgctcagttcctggaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctaggagaatgctgtgctgtggatgactgcagctggccgcctgaggggacgccagactcagctcttttctagcgactgaaagtagaagtctgtccgtctatgaacatgcgggggaaggatccggaaccaggacccagaagcacctcctttgtagacagagggccacggctgcgtgcgatccaggcccaggcccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttgtcgtggcgattggganntctaggtcactcagc

SEQ ID NO: 355377 - DNA, 4239 bp, Homo sapiens
gagatggaggcgctgcggcagatcaaagacacggtgacaatggatgctgggagagccaacaaggaggttgaaatccttcgaaagcagtgcaaggctctgtgccaggagctgaaggaagccctccaggaggcggatgtggccaagtgccggcgggactgggccttccaggagcgagacaagattgtagcagagcgtgacagcatccggacactgtgtgacaacctgaggcgggagcgggaccgtgcggtgagcgagctggctgaggccctgcgcagcctggatgacacccgcaagcagaagaatgatgtcagccgcgagctgaaggagctcaaggaacagatggaatcccagttggaaaaggaggcccggttccgacagctgatggcccacagctcccacgactcggccattgacacggattccatggagtgggaaacggaagttgtagagttcgagagggagacggaggatattgacttgaaggcactggggtttgatatggcagaaggtgtgaatgagccttgtttcccgggggactgtggcatatttgtcactaaagtggacaaaggaagcattgctgatggccgcttaagggtcaatgactggctgctgagaatcaacgatgtggacctcatcaacaaggacaagaagcaggccatcaaggcgctcctcaatggggagggggccatcaacatggtcgtgcggcggaggaagtccctgggtgggaaggtggtcacgccgctgcacatcaacctcagtggacagaaagacagtggcatcagtctggagaatggagtgtatgctgccgctgtgctgcctggaagccctgccgctaaagaagggtcccttgctgtgggagacaggatcgttgcgatcaatggcattgcactggacaacaagtctctgaatgaatgtgaatctctgctgcggagctgccaggactccctgaccctgtccctcctgaaggtattccctcagagctcctcgtggagtggccagaacatttttgaaaatatcaaagactctgataagatgctgagttttcgagcccatggcccggaggtccaggctcataacaaacggaacttgatacagcacaataactccacgcagacagacatcttctacacggacaggctggaagacaggaaggagccaggccccccaggaggcagcagctcctttctgcataagccattccctgggggacccttgcaggtctgcccccaggcctgtcccagtgcctctgagcgtagcctgagctccttccgctcagatgcctctggggaccgtggctttgggctggtggacgtgcgtggccggcggccactgctgccctttgagaccgaggtgggcccctgtggggttggggaggcctccctggacaaggcagactctgaaggctccaacagcggcgggacctggcccaaggccatgctcagctccacggcagtgcctgagaagctctctgtttataaaaagccaaagcaaagaaagtccatctttgaccctaacactttcaaacgcccccagacaccccccaaaatagactacctgcttccaggtcctgggcctgctcactctccccagccctccaagagggcggggcctctgacacccccaaaacctcccagaaggagcgactccattaagttccagcacaggctggagactagctccgagtcagaagccactctggtgggcagctccccatccactagtcccccgagcgccctgccccctgacgtggaccccggggagcccatgcacgcatcaccccctcgcaaggccagggtccgcattgcttccagctactaccctgaaggagatggggactcctcccacctgccggccaagaaatcctgtgatgaggacctcacctcccagaaggtggatgagctggggcagaagcgtcgccggccaaaatctgctcccagttttcggccgaagcttgctccagtagtgattcctgctcagttcctggaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcaagagaccccaaagagcaaagaccccaaaagagcaaagaccccataagagcaaagaccccaaaagagcaaagaccccaaaagagcaaagaccccaacaaggggt

SEQ ID NO: 355378 - DNA, 3594 bp, Homo sapiens
gagatggaggcgctgcggcagatcaaagacacggtgacaatggatgctgggagagccaacaaggaggttgaaatccttcgaaagcagtgcaaggctctgtgccaggagctgaaggaagccctccaggaggcggatgtggccaagtgccggcgggactgggccttccaggagcgagacaagattgtagcagagcgtgacagcatccggacactgtgtgacaacctgaggcgggagcgggaccgtgcggtgagcgagctggctgaggccctgcgcagcctggatgacacccgcaagcagaagaatgatgtcagccgcgagctgaaggagctcaaggaacagatggaatcccagttggaaaaggaggcccggttccgacagctgatggcccacagctcccacgactcggccattgacacggattccatggagtgggaaacggaagttgtagagttcgagagggagacggaggatattgacttgaaggcactggggtttgatatggcagaaggtgtgaatgagccttgtttcccgggggactgtggcatatttgtcactaaagtggacaaaggaagcattgctgatggccgcttaagggtcaatgactggctgctgagaatcaacgatgtggacctcatcaacaaggacaagaagcaggccatcaaggcgctcctcaatggggagggggccatcaacatggtcgtgcggcggaggaagtccctgggtgggaaggtggtcacgccgctgcacatcaacctcagtggacagaaagacagtggcatcagtctggagaatggagtgtatgctgccgctgtgctgcctggaagccctgccgctaaagaagggtcccttgctgtgggagacaggatcgttgcgatcaatggcattgcactggacaacaagtctctgaatgaatgtgaatctctgctgcggagctgccaggactccctgaccctgtccctcctgaaggtattccctcagagctcctcgtggagtggccagaacatttttgaaaatatcaaagactctgataagatgctgagttttcgagcccatggcccggaggtccaggctcataacaaacggaacttgatacagcacaataactccacgcagacagacatcttctacacggacaggctggaagacaggaaggagccaggccccccaggaggcagcagctcctttctgcataagccattccctgggggacccttgcaggtctgcccccaggcctgtcccagtgcctctgagcgtagcctgagctccttccgctcagatgcctctggggaccgtggctttgggctggtggacgtgcgtggccggcggccactgctgccctttgagaccgaggtgggcccctgtggggttggggaggcctccctggacaaggcagactctgaaggctccaacagcggcgggacctggcccaaggccatgctcagctccacggcagtgcctgagaagctctctgtttataaaaagccaaagcaaagaaagtccatctttgaccctaacactttcaaacgcccccagacaccccccaaaatagactacctgcttccaggtcctgggcctgctcactctccccagccctccaagagggcggggcctctgacacccccaaaacctcccagaaggagcgactccattaagttccagcacaggctggagactagctccgagtcagaagccactctggtgggcagctccccatccactagtcccccgagcgccctgccccctgacgtggaccccggggagcccatgcacgcatcaccccctcgcaaggccagggtccgcattgcttccagctactaccctgaaggagatggggactcctcccacctgccggccaagaaatcctgtgatgaggacctcacctcccagaaggtggatgagctggggcagaagcgtcgccggccaaaatctgctcccagttttcggccgaagcttgctccagtagtgattcctgctcagttcctggaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattgtcgacgcggccgcgaatttagtagtag

SEQ ID NO: 355379 - DNA, 2962 bp, Homo sapiens
gagatggaggcgctgcggcagatcaaagacacggtgacaatggatgctgggagagccaacaaggaggttgaaatccttcgaaagcagtgcaaggctctgtgccaggagctgaaggaagccctccaggaggcggatgtggccaagtgccggcgggactgggccttccaggagcgagacaagattgtagcagagcgtgacagcatccggacactgtgtgacaacctgaggcgggagcgggaccgtgcggtgagcgagctggctgaggccctgcgcagcctggatgacacccgcaagcagaagaatgatgtcagccgcgagctgaaggagctcaaggaacagatggaatcccagttggaaaaggaggcccggttccgacagctgatggcccacagctcccacgactcggccattgacacggattccatggagtgggaaacggaagttgtagagttcgagagggagacggaggatattgacttgaaggcactggggtttgatatggcagaaggtgtgaatgagccttgtttcccgggggactgtggcatatttgtcactaaagtggacaaaggaagcattgctgatggccgcttaagggtcaatgactggctgctgagaatcaacgatgtggacctcatcaacaaggacaagaagcaggccatcaaggcgctcctcaatggggagggggccatcaacatggtcgtgcggcggaggaagtccctgggtgggaaggtggtcacgccgctgcacatcaacctcagtggacagaaagacagtggcatcagtctggagaatggagtgtatgctgccgctgtgctgcctggaagccctgccgctaaagaagggtcccttgctgtgggagacaggatcgttgcgatcaatggcattgcactggacaacaagtctctgaatgaatgtgaatctctgctgcggagctgccaggactccctgaccctgtccctcctgaaggtattccctcagagctcctcgtggagtggccagaacatttttgaaaatatcaaagactctgataagatgctgagttttcgagcccatggcccggaggtccaggctcataacaaacggaacttgatacagcacaataactccacgcagacagacatcttctacacggacaggctggaagacaggaaggagccaggccccccaggaggcagcagctcctttctgcataagccattccctgggggacccttgcaggtctgcccccaggcctgtcccagtgcctctgagcgtagcctgagctccttccgctcagatgcctctggggaccgtggctttgggctggtggacgtgcgtggccggcggccactgctgccctttgagaccgaggtgggcccctgtggggttggggaggcctccctggacaaggcagactctgaaggctccaacagcggcgggacctggcccaaggccatgctcagctccacggcagtgcctgagaagctctctgtttataaaaagccaaagcaaagaaagtccatctttgaccctaacactttcaaacgcccccagacaccccccaaaatagactacctgcttccaggtcctgggcctgctcactctccccagccctccaagagggcggggcctctgacacccccaaaacctcccagaaggagcgactccattaagttccagcacaggctggagactagctccgagtcagaagccactctggtgggcagctccccatccactagtcccccgagcgccctgccccctgacgtggaccccggggagcccatgcacgcatcaccccctcgcaaggccagggtccgcattgcttccagctactaccctgaaggagatggggactcctcccacctgccggccaagaaatcctgtgatgaggacctcacctcccagaaggtggatgagctggggcagaagcgtcgccggccaaaatctgctcccagttttcggccgaagcttgctccagtagtgattcctgctcagttcctggaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacagttgaggaaactggatccagacgttggagtgacagacctgtggccacgtggttagcggctggcaccgggactcattcttaccctttgctttttccctctcattcgaagctttctgttgtgaaataaaatatacacaggaagaaagcataaatgtgcagcctagctttttactggtactggttcattttagaatgtaggtccatcttaggtttcaggttgactgtaggcttgctgtctgtccagaggcacctcctccatggaatccgtcacccccgcgcactgtgcacacacatccctctctgttgttcccctagatggaacttactagattgtgtttatatttaacagcttctg

SEQ ID NO: 355380 - DNA, 4037 bp, Homo sapiens
tagcagacactcttgcccttgcatctgcaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctaggagaatgctgtgctgtggatgactgcagctggccgcctgaggggacgccagactcagctcttttctagcgactgaaagtagaagtctgtccgtctatgaacatgcgggggaaggatccggaaccaggacccagaagcacctcctttgtagacagagggccacggctgcgtgcgatccaggcccaggcccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttggtggcacctctcctggaaggacgtcacaactccaggtgctcagactgcctgtggcagcagaaccagtgcctttggcattttcctcccacaatggggaaggtgactttggcattcttacaaactcgtctctcggcctttctctcctgccttccacagcctctcgtttctcctccatctgtgcttattacttgaggactgtgtctgctccgtgagagctgcgtgggcagggctgcagtggggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggcttttttttttttggcacttctgaggctagatatgtctggctgaagatttgatgtggttcctccttaagctatgcgtcctgttaataataggtactgtactgggctctgtgtaagtgtcgttggggtaggacctatattttaatactgttcctaacatttcattttactagcgagaaatctttgatttcattttattctttgtaattctagacactagattgtagtttagccataactgatgttttttaaaaagggatatattttcttgcacagttgttcaaaaaagagacaagtttcagtcctcaatgctgtcctttgttttacaggtacaagttttctagctcagacaaactatgaaaaactgtagactattctcaaggtattaactcgcagaccctctgggggtaggggctgttttctaagttacaggcagagtgggactgagatggtacagtgtgcacagacaggtactgagctgacagactgggattttctgtactaaaatgttactttgtatcaaaagttaaacaggctttagtacaacaaataaaggtcaatttctgtaa

SEQ ID NO: 355381 - DNA, 5441 bp, Homo sapiens
ttctgagccaaggtcccacgccacatggccgggcacagcagtgccaagatgttccctccgggtcctcggtgttctgatcccagaaggacatgctcctcccctagcctgctgtgaagggcttatgtgttcctctacctcagaatccccttagttggactccttgggcctcaccagaaagacctctatcctttgccaactcctgactttggcaccttgcatttggtgactgtctagcacaggaggttaggtaggcagagatcctgactggtaggcctgaggccgctctgcctgtggcctgacatgctctctgtcctgctctagatcaatggcattgcactggacaacaagtctctgaatgaatgtgaatctctgctgcggagctgccaggactccctgaccctgtccctcctgaaggtattccctcagagctcctcgtggagtggccagaacatttttgaaaatatcaaagactctgataagatgctgagttttcgagcccatggcccggaggtccaggctcataacaaacggaacttgatacagcacaataactccacgcagacagacatcttctacacggacaggctggaagacaggaaggagccaggccccccaggaggcagcagctcctttctgcataagccattccctgggggacccttgcaggtctgcccccaggcctgtcccagtgcctctgagcgtagcctgagctccttccgctcagatgcctctggggaccgtggctttgggctggtggacgtgcgtggccggcggccactgctgccctttgagaccgaggtgggcccctgtggggttggggaggcctccctggacaaggcagactctgaaggctccaacagcggcgggacctggcccaaggccatgctcagctccacggcagtgcctgagaagctctctgtttataaaaagccaaagcaaagaaagtccatctttgaccctaacactttcaaacgcccccagacaccccccaaaatagactacctgcttccaggtcctgggcctgctcactctccccagccctccaagagggcggggcctctgacacccccaaaacctcccagaaggagcgactccattaagttccagcacaggctggagactagctccgagtcagaagccactctggtgggcagctccccatccactagtcccccgagcgccctgccccctgacgtggaccccggggagcccatgcacgcatcaccccctcgcaaggccagggtccgcattgcttccagctactaccctgaaggagatggggactcctcccacctgccggccaagaaatcctgtgatgaggacctcacctcccagaaggtggatgagctggggcagaagcgtcgccggccaaaatctgctcccagttttcggccgaagcttgctccagtagtgattcctgctcagttcctggaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctaggagaatgctgtgctgtggatgactgcagctggccgcctgaggggacgccagactcagctcttttctagcgactgaaagtagaagtctgtccgtctatgaacatgcgggggaaggatccggaaccaggacccagaagcacctcctttgtagacagagggccacggctgcgtgcgatccaggcccaggcccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttggtggcacctctcctggaaggacgtcacaactccaggtgctcagactgcctgtggcagcagaaccagtgcctttggcattttcctcccacaatggggaaggtgactttggcattcttacaaactcgtctctcggcctttctctcctgccttccacagcctctcgtttctcctccatctgtgcttattacttgaggactgtgtctgctccgtgagagctgcgtgggcagggctgcagtggggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggcttttttttttttggcacttctgaggctagatatgtctggctgaagatttgatgtggttcctccttaagctatgcgtcctgttaataataggtactgtactgggctctgtgtaagtgtcgttggggtaggacctatattttaatactgttcctaacatttcattttactagcgagaaatctttgatttcattttattctttgtaattctagacactagattgtagtttagccataactgatgttttttaaaaagggatatattttcttgcacagttgttcaaaaaagagacaagtttcagtcctcaatgctgtcctttgttttacaggtacaagttttctagctcagacaaactatgaaaaactgtagactattctcaaggtattaactcgcagaccctctgggggtaggggctgttttctaagttacaggcagagtgggactgagatggtacagtgtgcacagacaggtactgagctgacagactgggattttctgtactaaaatgttactttgtatcaaaagttaaacaggctttagtacaacaaataaaggtcaatttctgtaa

SEQ ID NO: 355382 - DNA, 4495 bp, Homo sapiens
gtacgatctcggctcactgcaagctccgcctgctgggttcacgccattctcctgcctcagcctcccgagtagctgggactacaagcgcatgccaccacgcctagctaattttttgtatttttagtagagatggggtttcaccatgttagccaggatggtctcgatctcctgacctcatgatccgcccacctcggcctcccaaagtgctgggattacaggtatgagccaccgcgcccggcccccctgacgtggaccccggggagcccatgcacgcatcaccccctcgcaaggccagggtccgcattgcttccagctactaccctgaaggagatggggactcctcccacctgccggccaagaaatcctgtgatgaggacctcacctcccagaaggtggatgagctggggcagaagcgtcgccggccaaaatctgctcccagttttcggccgaagcttgctccagtagtgattcctgctcagttcctggaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctaggagaatgctgtgctgtggatgactgcagctggccgcctgaggggacgccagactcagctcttttctagcgactgaaagtagaagtctgtccgtctatgaacatgcgggggaaggatccggaaccaggacccagaagcacctcctttgtagacagagggccacggctgcgtgcgatccaggcccaggcccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttggtggcacctctcctggaaggacgtcacaactccaggtgctcagactgcctgtggcagcagaaccagtgcctttggcattttcctcccacaatggggaaggtgactttggcattcttacaaactcgtctctcggcctttctctcctgccttccacagcctctcgtttctcctccatctgtgcttattacttgaggactgtgtctgctccgtgagagctgcgtgggcagggctgcagtggggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggcttttttttttttggcacttctgaggctagatatgtctggctgaagatttgatgtggttcctccttaagctatgcgtcctgttaataataggtactgtactgggctctgtgtaagtgtcgttggggtaggacctatattttaatactgttcctaacatttcattttactagcgagaaatctttgatttcattttattctttgtaattctagacactagattgtagtttagccataactgatgttttttaaaaagggatatattttcttgcacagttgttcaaaaaagagacaagtttcagtcctcaatgctgtcctttgttttacaggtacaagttttctagctcagacaaactatgaaaaactgtagactattctcaaggtattaactcgcagaccctctgggggtaggggctgttttctaagttacaggcagagtgggactgagatggtacagtgtgcacagacaggtactgagctgacagactgggattttctgtactaaaatgttactttgtatcaaaagttaaacaggctttagtacaacaaataaaggtcaatttctgtaa

SEQ ID NO: 355383 - DNA, 2797 bp, Homo sapiens
ctgccttctgatgcatccacccccatccctggcagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctaggagaatgctgtgctgtggatgactgcagctggccgcctgaggggacgccagactcagctcttttctagcgactgaaagtagaagtctgtccgtctatgaacatgcgggggaaggatccggaaccaggacccagaagcacctcctttgtagacagagggccacggctgcgtgcgatccaggcccaggcccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttggtggcacctctcctggaaggacgtcacaactccaggtgctcagactgcctgtggcagcagaaccagtgcctttggcattttcctcccacaatggggaaggtgactttggcattcttacaaactcgtctctcggcctttctctcctgccttccacagcctctcgtttctcctccatctgtgcttattacttgaggactgtgtctgctccgtgagagctgcgtgggcagggctgcagtggggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggcttttttttttttggcacttctgaggctagatatgtctggctgaagatttgatgtggttcctccttaagctatgcgtcctgttaataataggtactgtactgggctctgtgtaagtgtcgttggggtaggacctatattttaatactgttcctaacatttcattttactagcgagaaatctttgatttcattttattctttgtaattctagacactagattgtagtttagccataactgatgttttttaaaaagggatatattttcttgcacagttgttcaaaaaagagacaagtttcagtcctcaatgctgtcctttgttttacaggtacaagttttctagctcagacaaactatgaaaaactgtagactattctcaaggtattaactcgcagaccctctgggggtaggggctgttttctaagttacaggcagagtgggactgagatggtacagtgtgcacagacaggtactgagctgacagactgggattttctgtactaaaatgttactttgtatcaaaagttaaacaggctttagtacaacaaataaaggtcaatttctgtaa

SEQ ID NO: 355384 - DNA, 3731 bp, Homo sapiens
tagcagacactcttgcccttgcatctgcaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctaggagaatgctgtgctgtggatgactgcagctggccgcctgaggggacgccagactcagctcttttctagcgactgaaagtagaagtctgtccgtctatgaacatgcgggggaaggatccggaaccaggacccagaagcacctcctttgtagacagagggccacggctgcgtgcgatccaggcccaggcccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttggtggcacctctcctggaaggacgtcacaactccaggtgctcagactgcctgtggcagcagaaccagtgcctttggcattttcctcccacaatggggaaggtgactttggcattcttacaaactcgtctctcggcctttctctcctgccttccacagcctctcgtttctcctccatctgtgcttattacttgaggactgtgtctgctccgtgagagctgcgtgggcagggctgcagtggggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggcttttttttttttggcacttctgaggctagatatgtctggctgaagatttgatgtggttcctccttaagctatgcgtcctgttaataataggtactgtactgggctctgtgtaagtgtcgttggggtaggacctatattttaatactgttcctaacatttcattttactagcgagaaatctttgatttcattttattctttgtaattctagacactagattgtagtttagccacgactttgttcggggtcacgagctcgaa

SEQ ID NO: 355385 - DNA, 4680 bp, Homo sapiens
gagatggaggcgctgcggcagatcaaagacacggtgacaatggatgctgggagagccaacaaggaggttgaaatccttcgaaagcagtgcaaggctctgtgccaggagctgaaggaagccctccaggaggcggatgtggccaagtgccggcgggactgggccttccaggagcgagacaagattgtagcagagcgtgacagcatccggacactgtgtgacaacctgaggcgggagcgggaccgtgcggtgagcgagctggctgaggccctgcgcagcctggatgacacccgcaagcagaagaatgatgtcagccgcgagctgaaggagctcaaggaacagatggaatcccagttggaaaaggaggcccggttccgacagctgatggcccacagctcccacgactcggccattgacacggattccatggagtgggaaacggaagttgtagagttcgagagggagacggaggatattgacttgaaggcactggggtttgatatggcagaaggtgtgaatgagccttgtttcccgggggactgtggcatatttgtcactaaagtggacaaaggaagcattgctgatggccgcttaagggtcaatgactggctgctgagaatcaacgatgtggacctcatcaacaaggacaagaagcaggccatcaaggcgctcctcaatggggagggggccatcaacatggtcgtgcggcggaggaagtccctgggtgggaaggtggtcacgccgctgcacatcaacctcagtggacagaaagacagtggcatcagtctggagaatggagtgtatgctgccgctgtgctgcctggaagccctgccgctaaagaagggtcccttgctgtgggagacaggatcgttgcgatcaatggcattgcactggacaacaagtctctgaatgaatgtgaatctctgctgcggagctgccaggactccctgaccctgtccctcctgaaggtattccctcagagctcctcgtggagtggccagaacatttttgaaaatatcaaagactctgataagatgctgagttttcgagcccatggcccggaggtccaggctcataacaaacggaacttgatacagcacaataactccacgcagacagacatcttctacacggacaggctggaagacaggaaggagccaggccccccaggaggcagcagctcctttctgcataagccattccctgggggacccttgcaggtctgcccccaggcctgtcccagtgcctctgagcgtagcctgagctccttccgctcagatgcctctggggaccgtggctttgggctggtggacgtgcgtggccggcggccactgctgccctttgagaccgaggtgggcccctgtggggttggggaggcctccctggacaaggcagactctgaaggctccaacagcggcgggacctggcccaaggccatgctcagctccacggcagtgcctgagaagctctctgtttataaaaagccaaagcaaagaaagtccatctttgaccctaacactttcaaacgcccccagacaccccccaaaatagactacctgcttccaggtcctgggcctgctcactctccccagccctccaagagggcggggcctctgacacccccaaaacctcccagaaggagcgactccattaagttccagcacaggctggagactagctccgagtcagaagccactctggtgggcagctccccatccactagtcccccgagcgccctgccccctgacgtggaccccggggagcccatgcacgcatcaccccctcgcaaggccagggtccgcattgcttccagctactaccctgaaggagatggggactcctcccacctgccggccaagaaatcctgtgatgaggacctcacctcccagaaggtggatgagctggggcagaagcgtcgccggccaaaatctgctcccagttttcggccgaagcttgctccagtagtgattcctgctcagttcctggaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggtaggtgtgcgtgggcctggagtggggagcaggcagcagggaaggaagcagaggcttcctaaggctgttttcttagccgtggagaagcccgcactttctacatgctcccaagtgctgtcatgagcacgttcctgacaagtcaggtgttcagattgcagtccctggccaacgtcaggattcttacaggttgaatgttaagctcaccgatcttggcctcaggtcctgcctggcttgcctgctcattttcacacgtgcagtggtgggtctgtctcatagcacaggtgcagtttagtgcagccacagtgtccccaggcagggcggggactggagcagcccccagtgtgccagcagtgtgggcagcggaggctaggggcccatctgtccctagcaccctccagggcagtcccgttttgcagcgggatttggcaaacccccctcca

SEQ ID NO: 355386 - DNA, 4596 bp, Homo sapiens
gagatggaggcgctgcggcagatcaaagacacggtgacaatggatgctgggagagccaacaaggaggttgaaatccttcgaaagcagtgcaaggctctgtgccaggagctgaaggaagccctccaggaggcggatgtggccaagtgccggcgggactgggccttccaggagcgagacaagattgtagcagagcgtgacagcatccggacactgtgtgacaacctgaggcgggagcgggaccgtgcggtgagcgagctggctgaggccctgcgcagcctggatgacacccgcaagcagaagaatgatgtcagccgcgagctgaaggagctcaaggaacagatggaatcccagttggaaaaggaggcccggttccgacagctgatggcccacagctcccacgactcggccattgacacggattccatggagtgggaaacggaagttgtagagttcgagagggagacggaggatattgacttgaaggcactggggtttgatatggcagaaggtgtgaatgagccttgtttcccgggggactgtggcatatttgtcactaaagtggacaaaggaagcattgctgatggccgcttaagggtcaatgactggctgctgagaatcaacgatgtggacctcatcaacaaggacaagaagcaggccatcaaggcgctcctcaatggggagggggccatcaacatggtcgtgcggcggaggaagtccctgggtgggaaggtggtcacgccgctgcacatcaacctcagtggacagaaagacagtggcatcagtctggagaatggagtgtatgctgccgctgtgctgcctggaagccctgccgctaaagaagggtcccttgctgtgggagacaggatcgttgcgatcaatggcattgcactggacaacaagtctctgaatgaatgtgaatctctgctgcggagctgccaggactccctgaccctgtccctcctgaaggtattccctcagagctcctcgtggagtggccagaacatttttgaaaatatcaaagactctgataagatgctgagttttcgagcccatggcccggaggtccaggctcataacaaacggaacttgatacagcacaataactccacgcagacagacatcttctacacggacaggctggaagacaggaaggagccaggccccccaggaggcagcagctcctttctgcataagccattccctgggggacccttgcaggtctgcccccaggcctgtcccagtgcctctgagcgtagcctgagctccttccgctcagatgcctctggggaccgtggctttgggctggtggacgtgcgtggccggcggccactgctgccctttgagaccgaggtgggcccctgtggggttggggaggcctccctggacaaggcagactctgaaggctccaacagcggcgggacctggcccaaggccatgctcagctccacggcagtgcctgagaagctctctgtttataaaaagccaaagcaaagaaagtccatctttgaccctaacactttcaaacgcccccagacaccccccaaaatagactacctgcttccaggtcctgggcctgctcactctccccagccctccaagagggcggggcctctgacacccccaaaacctcccagaaggagcgactccattaagttccagcacaggctggagactagctccgagtcagaagccactctggtgggcagctccccatccactagtcccccgagcgccctgccccctgacgtggaccccggggagcccatgcacgcatcaccccctcgcaaggccagggtccgcattgcttccagctactaccctgaaggagatggggactcctcccacctgccggccaagaaatcctgtgatgaggacctcacctcccagaaggtggatgagctggggcagaagcgtcgccggccaaaatctgctcccagttttcggccgaagcttgctccagtagtgattcctgctcagttcctggaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctaggagaatgctgtgctgtggatgactgcagctggccgcctgaggggacgccagactcagctcttttctagcgactgaaagtagaagtctgctcgtgccgaattcggcacgaggcgagcgtggtgtgcaaggtccccctggtcctgctggtccccgaggggccaacggtgctcccggcaacgatggtgctaagggtgatgctggtgcccctggagctcccggtagccagggcgcccctggccttcagggaatgcc

SEQ ID NO: 355387 - DNA, 4328 bp, Homo sapiens
gagatggaggcgctgcggcagatcaaagacacggtgacaatggatgctgggagagccaacaaggaggttgaaatccttcgaaagcagtgcaaggctctgtgccaggagctgaaggaagccctccaggaggcggatgtggccaagtgccggcgggactgggccttccaggagcgagacaagattgtagcagagcgtgacagcatccggacactgtgtgacaacctgaggcgggagcgggaccgtgcggtgagcgagctggctgaggccctgcgcagcctggatgacacccgcaagcagaagaatgatgtcagccgcgagctgaaggagctcaaggaacagatggaatcccagttggaaaaggaggcccggttccgacagctgatggcccacagctcccacgactcggccattgacacggattccatggagtgggaaacggaagttgtagagttcgagagggagacggaggatattgacttgaaggcactggggtttgatatggcagaaggtgtgaatgagccttgtttcccgggggactgtggcatatttgtcactaaagtggacaaaggaagcattgctgatggccgcttaagggtcaatgactggctgctgagaatcaacgatgtggacctcatcaacaaggacaagaagcaggccatcaaggcgctcctcaatggggagggggccatcaacatggtcgtgcggcggaggaagtccctgggtgggaaggtggtcacgccgctgcacatcaacctcagtggacagaaagacagtggcatcagtctggagaatggagtgtatgctgccgctgtgctgcctggaagccctgccgctaaagaagggtcccttgctgtgggagacaggatcgttgcgatcaatggcattgcactggacaacaagtctctgaatgaatgtgaatctctgctgcggagctgccaggactccctgaccctgtccctcctgaaggtattccctcagagctcctcgtggagtggccagaacatttttgaaaatatcaaagactctgataagatgctgagttttcgagcccatggcccggaggtccaggctcataacaaacggaacttgatacagcacaataactccacgcagacagacatcttctacacggacaggctggaagacaggaaggagccaggccccccaggaggcagcagctcctttctgcataagccattccctgggggacccttgcaggtctgcccccaggcctgtcccagtgcctctgagcgtagcctgagctccttccgctcagatgcctctggggaccgtggctttgggctggtggacgtgcgtggccggcggccactgctgccctttgagaccgaggtgggcccctgtggggttggggaggcctccctggacaaggcagactctgaaggctccaacagcggcgggacctggcccaaggccatgctcagctccacggcagtgcctgagaagctctctgtttataaaaagccaaagcaaagaaagtccatctttgaccctaacactttcaaacgcccccagacaccccccaaaatagactacctgcttccaggtcctgggcctgctcactctccccagccctccaagagggcggggcctctgacacccccaaaacctcccagaaggagcgactccattaagttccagcacaggctggagactagctccgagtcagaagccactctggtgggcagctccccatccactagtcccccgagcgccctgccccctgacgtggaccccggggagcccatgcacgcatcaccccctcgcaaggccagggtccgcattgcttccagctactaccctgaaggagatggggactcctcccacctgccggccaagaaatcctgtgatgaggacctcacctcccagaaggtggatgagctggggcagaagcgtcgccggccaaaatctgctcccagttttcggccgaagcttgctccagtagtgattcctgctcagttcctggaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcaaagaccccaaaagcttttggggtctttctttctttttttatttttttgggagacagagttgggctcttacacccaggggggagtgaaggggccattctcaagctcaaagaaacttcaaccccagggtccaggggatcctcgtgcctaagcctccggagaagcggggataatagataccggcacaaggcccac

SEQ ID NO: 355388 - DNA, 195 bp, Homo sapiens
ggggttccccagccccactcaggtcctccactccaagctgggtccgtgacgctgctgctctctctccctcagattcggtgagcctggcctatcagcgggtccagaaggtggactgcaccgctctgaggcctgtcctgattctggggcctttgctggacgtggtgaaggagatgctggtgaatgaggctcctggca

SEQ ID NO: 355389 - DNA, 439 bp, Homo sapiens
cagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaa

SEQ ID NO: 355390 - DNA, 257 bp, Homo sapiens
ctgacacatagtaggctgtcaatagatatatgttcaacatatgaatgaatgaatgaaaaagcaatcaggcactttgatttagaatgtgtgtatacacacacacacatcatatatatatttatatataaaacaacagatgtcatacatatacatatatacacgcatgtatgtatatatgtatgcgtaatgatatacatgcatgtatatacatatatacatacatatatgtgtacatgcacacatatatgtgtatatat

SEQ ID NO: 355391 - DNA, 773 bp, Homo sapiens
gtgattgtcctcagtgtaccttctggcggcaggtgcagacacgagtttgcccacattctgcattgatgataaacagtttactgtatgatcatataacctccagtggaatgctgagttggtcacgaccctcaagtctttggctcccaacccttaggtaggaccttaggacactacacacggttcggcctcattgcttcttatttaaatttgttcatactctccagggtgactggtttgtccctgcattctccaaatatacgggatgcagggcctcaaatcctccaccctcataccacagcctaactcttcaagggcttgcagtgaaatctgtgtctgaacatttcacatgagaggaaagcagagaataaccactagacatttgcctgaaaaatcctttctgcctctcctcctcttatctttccgagacacagacaccttatcaggatgtctttgggatgcggttcctttctggaaactgtacagggtgatgtgtcttcagtacaccctcctatcttttcctggttttgggttttagaactgcctcgggctgactcaagttccccacaactgccatgtctcctggagggtctagtgggtatcagtgcctaggggagtggggcctcccaagggagcagctgaatgccttatggtggcagagatgcctggtatacgcttcatctagataaccaattctctgagttctcagcttctccctcccaactccagtttccattaattggagacacatggctggtcagccaattggatgttgc

SEQ ID NO: 355392 - DNA, 523 bp, Homo sapiens
gtctcctcccctctctgggcctttggaagataaggaacctgccatttctcagagggtctgccctgttgctgggattcctcaccagagttcttgcctcctcttcgggcagtggcctgcagcagcccctcccagagcagaaatcctagggttttaggaagcagaggtggggaacagggttggactgcctgggcctcaggtctctggagggaccagggtctctggccttcaaccccctgttaggagctgctacccctccctgtgccctgtgctcaccctctcttctcccccaggggcagctggactctctgtgacatctaaagttatcgggggctttgctgggacagctcttggggcctggctgggttcacccccttccagctgaacaccacactgaggcagggagttggctctcttggtggagatgactttcctgggcctctggatgacaatcttccaaaggacaagtctcctactcccaaaactatttaaggaagcatgaaaaataaagatgctggttatcttc

SEQ ID NO: 355393 - DNA, 531 bp, Homo sapiens
tctgggggactcccgtcccattggcccaaccccaaatctccacttcccgcagttgtggctgtggggactgtgctcgtggcgctcagtgccatgggcttcacctcagtaggaatcgccgcatcctccatagcagccaagatgatgtctacagcagccattgccaacgggggcggagttgctgctggcagtctggtggctattctgcagtcagtgggtgagtgttctggacaggatgaccagagccaggagatgatccagccccgaggctgaaccagggaggcctctcctctccctgcaggggcagctggactctctgtgacatctaaagttatcgggggctttgctgggacagctcttggggcctggctgggttcacccccttccagctgaacaccacactgaggcagggagttggctctcttggtggagatgactttcctgggcctctggatgacaatcttccaaaggacaagtctcctactcccaaaactatttaaggaagcatgaaaaataaagatgctggttatcttc

SEQ ID NO: 355394 - DNA, 1035 bp, Homo sapiens
cggccgccctctctggacccgggaacccaccggcccagagcgacccacgataggaacccaccggcccagagcgacccgcgataggaacccgggttcctggcctcagcccctctccagagtcggctccaaccccgctcgttttggtactcaccgtgtggagacgccaccgcagctccgtcagtcgcgagtgaagaacctcagaaaccgccgctgtacctcagctgcagcagcaactgcagttccggggcgggacctccacgcacgtactcgtgcgcgctggggaggaagtcccgcccctatggcaaactcagctacctgattggctgcctcgcggaccgcagcagtgccggcgggagagctggcttggggcgctggcacctcctcttacagctttactcctgccagcttgggaaaaggccggagaaggtgaaattctgtgtgctccctccggcgagagactttgtcagctcccgcacagtaacctttatccaaaccagatcctgaataaagtcaaaactcaaccaacaggtggaagtccaagaatccgagtggaggctcaccgaggcgaaggggccaaccatgggaaaggagagtggatgggactcaggcagggctgctgtagcagctgtggtcggaggagttgtggctgtggggactgtgctcgtggcgctcagtgccatgggcttcacctcagtaggaatcgccgcatcctccatagcagccaagatgatgtctacagcagccattgccaacgggggcggagttgctgctggcagtctggtggctattctgcagtcagtgggggcagctggactctctgtgacatctaaagttatcgggggctttgctgggacagctcttggggcctggctgggttcacccccttccagctgaacaccacactgaggcagggagttggctctcttggtggagatgactttcctgggcctctggatgacaatcttccaaaggacaagtctcctactcccaaaactatttaaggaagcatgaaaaataaagatgctggttatcttc

SEQ ID NO: 355395 - DNA, 989 bp, Homo sapiens
cggccgccctctctggacccgggaacccaccggcccagagcgacccacgataggaacccaccggcccagagcgacccgcgataggaacccgggttcctggcctcagcccctctccagagtcggctccaaccccgctcgttttggtactcaccgtgtggagacgccaccgcagctccgtcagtcgcgagtgaagaacctcagaaaccgccgctgtacctcagctgcagcagcaactgcagttccggggcgggacctccacgcacgtactcgtgcgcgctggggaggaagtcccgcccctatggcaaactcagctacctgattggctgcctcgcggaccgcagcagtgccggcgggagagctggcttggggcgctggcacctcctcttacagctttactcctgccagcttgggaaaaggccggagaaggtgaaattctgtgtgctccctccggcgagagactttgtcagctcccgcacagtaacgtggaagtccaagaatccgagtggaggctcaccgaggcgaaggggccaaccatgggaaaggagagtggatgggactcaggcagggctgctgtagcagctgtggtcggaggagttgtggctgtggggactgtgctcgtggcgctcagtgccatgggcttcacctcagtaggaatcgccgcatcctccatagcagccaagatgatgtctacagcagccattgccaacgggggcggagttgctgctggcagtctggtggctattctgcagtcagtgggggcagctggactctctgtgacatctaaagttatcgggggctttgctgggacagctcttggggcctggctgggttcacccccttccagctgaacaccacactgaggcagggagttggctctcttggtggagatgactttcctgggcctctggatgacaatcttccaaaggacaagtctcctactcccaaaactatttaaggaagcatgaaaaataaagatgctggttatcttc

SEQ ID NO: 355396 - DNA, 827 bp, Homo sapiens
cggccgccctctctggacccgggaacccaccggcccagagcgacccacgataggaacccaccggcccagagcgacccgcgataggaacccgggttcctggcctcagcccctctccagagtcggctccaaccccgctcgttttggtactcaccgtgtggagacgccaccgcagctccgtcagtcgcgagtgaagaacctcagaaaccgccgctgtacctcagctgcagcagcaactgcagttccggggcgggacctccacgcacgtactcgtgcgcgctggggaggaagtcccgcccctatggcaaactcagctacctgattggctgcctcgcggaccgcagcagtgccggcgggagagctggcttggggcgctggcacctcctcttacagctttactcctgccagcttgggaaaaggccggagaaggtgaaattctgtgtgctccctccggcgagagactttgtcagctcccgcacagtaacgtggaagtccaagaatccgagtggaggctcaccgaggcgaaggggccaaccatgggaaaggagagtggatgggactcaggcagggctgctgtagcagctgtggtcggaggaggggcagctggactctctgtgacatctaaagttatcgggggctttgctgggacagctcttggggcctggctgggttcacccccttccagctgaacaccacactgaggcagggagttggctctcttggtggagatgactttcctgggcctctggatgacaatcttccaaaggacaagtctcctactcccaaaactatttaaggaagcatgaaaaataaagatgctggttatcttc

SEQ ID NO: 355397 - DNA, 1209 bp, Homo sapiens
  misc_feature (1136)..(1136): n is a, c, g, or t
cggccgccctctctggacccgggaacccaccggcccagagcgacccacgataggaacccaccggcccagagcgacccgcgataggaacccgggttcctggcctcagcccctctccagagtcggctccaaccccgctcgttttggtactcaccgtgtggagacgccaccgcagctccgtcagtcgcgagtgaagaacctcagaaaccgccgctgtacctcagctgcagcagcaactgcagttccggggcgggacctccacgcacgtactcgtgcgcgctggggaggaagtcccgcccctatggcaaactcagctacctgattggctgcctcgcggaccgcagcagtgccggcgggagagctggcttggggcgctggcacctcctcttacagctttactcctgccagcttgggaaaaggccggagaaggtgaaattctgtgtgctccctccggcgagagactttgtcagctcccgcacagtaacgtggaagtccaagaatccgagtggaggctcaccgaggcgaaggggccaaccatgggaaaggagagtggatgggactcaggcagggctgctgtagcagctgtggtcggaggagttgtggctgtggggactgtgctcgtggcgctcagtgccatgggcttcacctcagtaggaatcgccgcatcctccatagcagccaagatgatgtctacagcagccattgccaacgggggcggagttgctgctggcagtctggtggctattctgcagtcagtgggggcagctggactctctgtgacatctaaagttatcgggggctttgctgggacagctcttggggcctggctgggttcacccccttccagctgaacaccacactgaggcagggagttggctctcttggtggagatgactttcctgggcctctggatgacaatcttccaaaggacaagtctcctactcccaaaactatttaaggaagcatgaaaaataaagatgctggttatcttcaaaagaacaaacatgccacaatgacctggcctaatacgttacgtcgatggaaccgcgttccctatgctgggcacccttcgcggtattcagcagctccaggggagaggaggggtttatgtttattcttggctaccgtgtatattcttngctttctacgccatgccgactagttacgagcgcacacgcagtacggcacacagcagcaccacgacatacggct

SEQ ID NO: 355398 - DNA, 993 bp, Homo sapiens
cggccgccctctctggacccgggaacccaccggcccagagcgacccacgataggaacccaccggcccagagcgacccgcgataggaacccgggttcctggcctcagcccctctccagagtcggctccaaccccgctcgttttggtactcaccgtgtggagacgccaccgcagctccgtcagtcgcgagtgaagaacctcagaaaccgccgctgtacctcagctgcagcagcaactgcagttccggggcgggacctccacgcacgtactcgtgcgcgctggggaggaagtcccgcccctatggcaaactcagctacctgattggctgcctcgcggaccgcagcagtgccggcgggagagctggcttggggcgctggcacctcctcttacagctttactcctgccagcttgggaaaaggccggagaaggtgaaattctgtgtgctccctccggcgagagactttgtcagctcccgcacagtaacgtggaagtccaagaatccgagtggaggctcaccgaggcgaaggggccaaccatgggaaaggagagtggatgggactcaggcagggctgctgtagcagctgtggtcggaggagttgtggctgtggggactgtgctcgtggcgctcagtgccatgggcttcacctcagtaggaatcgccgcatcctccatagcagccaagatgatgtctacagcagccattgccaacgggggcggagttgctgctggcagtctggtggctattctgcagtcagtgggggcagctggactctctgtgacatctaaagttatcgggggctttgctgggacagctcttggggcctggctgggttcacccccttccagctgaacaccacactgaggcagggagttggctctcttggtgcaccaccccaccccactcccatgtaggaaactaaaatccagtgtggtttgtattttttcccccatctttttaatctagtatcttcaatgaacctgctcagaaagtccgg

SEQ ID NO: 355399 - DNA, 511 bp, Homo sapiens
ctgggccacagtgctcagatatgtggctgaacattattttggatattctatgagggtgatttttggagaagattaacatttaatggttggactttgagtaaagcagattaccctccacaatgtggatgggcccccatccagttagttgaaggacttaatataaaacactgacctcacacaagcaagaagttctgccagatgactgcttttgaactcaaactgcaaggtgtatgtatataatagaaacatatattttgtttctcccattttatccaaatgaaaacataccatacctacttttctgcatcttgctttttgtacttaaccctttaaatatgtaagttcttgaagaactttccatattcgctcataaataatttttcttcctttttttccttaacagccacatatttttccattgtatggctatacagtcattattattttttttttttgcatgaatgtaagtgcattgtctttgtagggtaaattcctagaggtggaaccacta

SEQ ID NO: 355400 - DNA, 289 bp, Homo sapiens
ccatcctggctaagacggtgaaatcccatctctactaaaaatacacaaaattagctgggcgtggtggcacacgcctgtagtcccagctattcaggaggctgaggcagcagaattgcttgaacctaggaggcagaggttgcagtgagccaagatcatgccactgcactccagcctgggcgacagagcaagaccctgtctcaaaaaataaataaataaataaatagaaatgttgtaaactaatgtcaagaaaatttctcagaatgggaaaaaagatcaagatggaaagtaa

SEQ ID NO: 355401 - DNA, 1737 bp, Homo sapiens
  misc_feature (1737)..(1737): n is a, c, g, or t
cgctgattggctgtggccgcggcgggggcgggacctggcggagagcggcggattcaagatggcggcggccaggaggcggcttccagcggagccggcgggaaaaagcgagacctccgcggcggcttccgccggaccgcgtcctctcctggcagggggcggtggcgggcaccggagccgcccttaggacttcacgccagagcagctagagaagaagcccctaatgtttaccttcgtcctcccggcctccacctttctgcgccgctgctcttgctcaacttccatctccctcagactccgcgcgggccgcccggcggtgacggggctgacacagagcagccttcgctctatttacactccctcccccgcgcttgggctcgccctccccccgcgacaactgtcacgcagccgcggccccgcccccgacacgcgccgccaatcagggggctgcgtttccggtctcgcgcacgcgcgctctgggcggtgcagcctgggcggagccccgccctttacgctcgccggccacagattggtgcgctcacgtacccgcctcctacggcaggaccagtaagcggaaagcggaggcctggcgcccgctgtgattggccgattttaaaatcccctgccaggctggccgagcggcaaaaagttcgcgctgctggtcccagcgcgggcggcccctgggctttgtgtccaccaggacagcgggccgggctccctgcaggcgcgggcggcgccgaacggtgctcagcaaccacccggacagggccaggccgttttctcccgctcaggcattagtcgttggctgtgggccgccgcgggaagttgaggcctaccacggaggaggctgctgaggtggatctcaggggatccgcaagggctccctcacccttgccgggaccctgggaacccgaaacaaaatcctacgccaccagcccgccgaatgcgccccctcggccgggggtcctgggtcttcagagaagaactcggccgaatgcggtcagaaagcccgcgaaccgcctggacctgcaggccccgccgcttggagctcccgcctttcccgaccgagcccgtgtctgctcgtgtgtctcactgatgtcttaggtctcaaaaaaaaaagaaaagaaaaaaaaaaaaaaaaaaaaaaaaaaaaaaaaaaaaaaaaaaccaacggaacatatatgttgtgggggggggaaacaagagggacagaaaagaggcacaacgagggcaaaaaatgaggaacaagacaccacagtattctgtgacaaaagggggagaaaactgcggggcacccaaatagagaggaccgctataatagacgacgaacaaacgcgcggtaaacacggctttatattctcgcgcaaagaggagacgaaagacaggacgggagaacaacgaggacgagaagcagcggagacgagcacgaagacgagaacagagagagagagagaagaacagacagaaatgaacgacgacaaggacagagaagaaggacagaacagagtggacggaggacacaagagaaagagaacagaaagagacgacagccgaagcacaacggaagcacaaagggagggagagagagcaagagaagaaaaaaagcaaaaaaaagaaaaaagaaaacaaagggaggaagacagaaagagaagagagcaaagaaaggagaaaaagaggaagacagagaggaggaggaagagaagagaaagagaaagaggaaagagagaagaggagagcaan

SEQ ID NO: 355402 - DNA, 3190 bp, Homo sapiens
cgctgattggctgtggccgcggcgggggcgggacctggcggagagcggcggattcaagatggcggcggccaggaggcggcttccagcggagccggcgggaaaaagcgagacctccgcggcggcttccgccggaccgcgtcctctcctggcagggggcggtggcgggcaccggagccgcccttaggacttcacgccagagcagctagagaagaagcccctaatgtttaccttcgtcctcccggcctccacctttctgcgccgctgctcttgctcaacttccatctccctcagactccgcgcgggccgcccggcggtgacggggctgacacagagcagccttcgctctatttacactccctcccccgcgcttgggctcgccctccccccgcgacaactgtcacgcagccgcggccccgcccccgacacgcgccgccaatcagggggctgcgtttccggtctcgcgcacgcgcgctctgggcggtgcagcctgggcggagccccgccctttacgctcgccggccacagattggtgcgctcacgtacccgcctcctacggcaggaccagtaagcggaaagcggaggcctggcgcccgctgtgattggccgattttaaaatcccctgccaggctggccgagcggcaaaaagttcgcgctgctggtcccagcgcgggcggcccctgggctttgtgtccaccaggacagcgggccgggctccctgcaggcgcgggcggcgccgaacggtgctcagcaaccacccggacagggccaggccgttttctcccgctcaggcattagtcgttggctgtgggccgccgcgggaagttgaggcctaccacggaggaggctgctgaggtggatctcaggggatccgcaagggctccctcacccttgccgggaccctgggaacccgaaacaaaatcctacgccaccagcccgccgaatgcgccccctcggccgggggtcctgggtcttcagagaagaactcggccgaatgcggtcagaaagcccgcgaaccgcctggacctgcaggccccgccgcttggagctcccgcctttcccgaccgagcccgtgtctgctcgtgtgtctcactgatgtcttaggtctcaaaaaaaaaagaaaagaaaaggtttttagtagacagaagagaaatggggccgtgggttcgtggtcccagggggaaactgacgtcgcatgaggtcgtcgtccctcagcttgagctcagcggaacataagcttgcagaggtggaaaccacggaaggtttgggtgtcttggagctctctggacaccgaaggcccggacacagtcccggggtccgcaccgcctgtgacctgtggcgggaccgccggggtgggcgttttctcagctggcgcgcgcgctggtctccaggaggtaaggcccgccctgcaggcaacaccggtgcttgggctcctgctgagcagttctttcctgcgagtaacagaaccagggagggaggtgggctgtggcctcccctgcccctacagtcgtctcctgcagctcccaccatgctggactcatcagcagcagagcaagtgacccgactgacgctgaagctcttgggacagaaagcctcttagtcattcctggagcacacagggcctttgcgtggagccaccgtctctgtcacggtctctcttcctcacagaagctggagcaagaacggcagaacgtggaagggggacctgagggcctccacctcgagccaggaaatgaggaccggccggacgatgccctgcagactgctctgaagagaaggagggaccttctgcagagactccgggaacaacacctcctggacgagctctctcgggcccaggcctggagcgggccaagcagaggagccctcgggtcagccctgcccccagagctgccccccacgggcatcctacccactgcctccccatccccgctggccccagacccgccaaggatcatcctgcctacggtcccccagcctcctgccaccatcattcagcagctccctcagcgagccactcatagcacagattcctcctccccaggccttccctactcaacggtcaggaagtattaaggaagacatggtggagctgctgctgctgcagaacgcacaggtgcaccagttggtcctgcagaactggatgctcaaggccctgcccccagccctgcaggacccgccacatgtgcccccgagggtcccacgagctgccaggccaaggctgcctgccgtgcaccaccaccaccaccaccaccatgctgtgtggccacctggggctgccactgtcctccagcccgcccccagcctgtggacgcctggcccaccctgagtgtgagtcacagagaccctggccggggcaccctccacccccaggcttcctcagggctgtgggctgtggcgggactatggaagggagcagggagagaccctgccaccacccggagtggctacgcgagtgtggactgcaggctcctcctggggaagctgggcaggctcgctttctggtcacggggccattccagggggcatcccttgctccgggtcccctgcagtgaggggcctgtgaaccccaccagggcaacagcccctcccagggacccctcctttcctgtagggcggcgccggcccacctgggagcctcagatccccctcttccatcacggaggtaaagttgaggccgtggacgccaccagcctgatgaaataaagatttcatccagaaagagtttaagaaaatctcagctcaggagccagaacagaaaagatcaatagctttagccacatggaagtgtgaacatcctgatggggaaaataccacaaagtctaatttaataactagggacacctgtgtgccacagctgtggcacagactcccactaaagaagtaggggtgcatggctcatgcctgtaatcccagcactttaagaggctgaggcaggaggatcacttgagctcaggaattcgagaccagcctgggtcacatagcaagaccccgtctctacaaaaaataaatttaaaaaactagccaggtgtggtgatatgcgcctgttatctcagcagctctgggggctgaggtgggaggattgcttgagcccaggagttagaagctgcagtgagctctgatggaaccactgcactatagcctggaccacagagcaggcccctgtctcaaaaataaaataaaaaagtgaaag

SEQ ID NO: 355403 - DNA, 2587 bp, Homo sapiens
cgctgattggctgtggccgcggcgggggcgggacctggcggagagcggcggattcaagatggcggcggccaggaggcggcttccagcggagccggcgggaaaaagcgagacctccgcggcggcttccgccggaccgcgtcctctcctggcagggggcggtggcgggcaccggagccgcccttaggacttcacgccagagcagctagagaagaagcccctaatgtttaccttcgtcctcccggcctccacctttctgcgccgctgctcttgctcaacttccatctccctcagactccgcgcgggccgcccggcggtgacggggctgacacagagcagccttcgctctatttacactccctcccccgcgcttgggctcgccctccccccgcgacaactgtcacgcagccgcggccccgcccccgacacgcgccgccaatcagggggctgcgtttccggtctcgcgcacgcgcgctctgggcggtgcagcctgggcggagccccgccctttacgctcgccggccacagattggtgcgctcacgtacccgcctcctacggcaggaccagtaagcggaaagcggaggcctggcgcccgctgtgattggccgattttaaaatcccctgccaggctggccgagcggcaaaaagttcgcgctgctggtcccagcgcgggcggcccctgggctttgtgtccaccaggacagcgggccgggctccctgcaggcgcgggcggcgccgaacggtgctcagcaaccacccggacagggccaggccgttttctcccgctcaggcattagtcgttggctgtgggccgccgcgggaagttgaggcctaccacggaggaggctgctgaggtggatctcaggggatccgcaagggctccctcacccttgccgggaccctgggaacccgaaacaaaatcctacgccaccagcccgccgaatgcgccccctcggccgggggtcctgggtcttcagagaagaactcggccgaatgcggtcagaaagcccgcgaaccgcctggacctgcaggccccgccgcttggagctcccgcctttcccgaccgagcccgtgtctgctcgtgtgtctcactgatgtcttaggtctcaaaaaaaaaagaaaagaaaaggtttttagtagacagaagagaaatggggccgtgggttcgtggtcccagggggaaactgacgtcgcatgaggtcgtcgtccctcagcttgagctcagcggaacataagcttgcagaggtggaaaccacggaaggtttgggtgtcttggagctctctggacaccgaaggcccggacacagtcccggggtccgcaccgcctgtgacctgtggcgggaccgccggggtgggcgttttctcagctggcgcgcgcgctggtctccaggaggtaaggcccgccctgcaggcaacaccggtgcttgggctcctgctgagcagttctttcctgcgagtaacagaaccagggagggaggtgggctgtggcctcccctgcccctacagtcgtctcctgcagctcccaccatgctggactcatcagcagcagagcaagtgacccgactgacgctgaagctcttgggacagaagctggagcaagaacggcagaacgtggaagggggacctgagggcctccacctcgagccaggaaatgaggaccggccggacgatgccctgcagactgctctgaagagaaggagggaccttctgcagagactccgggaacaacacctcctggacgagctctctcgggcccaggcctggagcgggccaagcagaggagccctcgggtcagccctgcccccagagctgccccccacgggcatcctacccactgcctccccatccccgctggccccagacccgccaaggatcatcctgcctacggtcccccagcctcctgccaccatcattcagcagctccctcagcgagccactcatagcacagattcctcctccccaggccttccctactcaacggtcaggaagtattaaggaagacatggtggagctgctgctgctgcagaacgcacaggtgcaccagttggtcctgcagaactggatgctcaaggccctgcccccagccctgcaggacagattctttcattcctgaagttccgcacaaggaggaaccctgtcccagtgcttccatctttgaaagtttgcaggtaggagacaggatgaccagagagttgccactgagctgcagagctccccagggacagccacctggtgctgacatggacgggcaggtgtgaacaccgaagggcccagcgcagctactggcagtaacactcacttctctcagaaccatcttttcgtgcctcttgaaggtgattccagagactctgtgctctcgttaaaagctcaaaccaaagctcagactccatttcctcttttcaaggtgactttccagcatggcatttctttctttctattaaaaatgtttttttttgagacagagttttgctcttgtcgcccaggctggagtgcaatggagcgatctcggctcactgcaagctccgcctcccaggatggtcttgatttcctgacctcgtgatccacctgcctcggcctcccaaagtgctg

SEQ ID NO: 355404 - DNA, 2134 bp, Homo sapiens
cgctgattggctgtggccgcggcgggggcgggacctggcggagagcggcggattcaagatggcggcggccaggaggcggcttccagcggagccggcgggaaaaagcgagacctccgcggcggcttccgccggaccgcgtcctctcctggcagggggcggtggcgggcaccggagccgcccttaggacttcacgccagagcagctagagaagaagcccctaatgtttaccttcgtcctcccggcctccacctttctgcgccgctgctcttgctcaacttccatctccctcagactccgcgcgggccgcccggcggtgacggggctgacacagagcagccttcgctctatttacactccctcccccgcgcttgggctcgccctccccccgcgacaactgtcacgcagccgcggccccgcccccgacacgcgccgccaatcagggggctgcgtttccggtctcgcgcacgcgcgctctgggcggtgcagcctgggcggagccccgccctttacgctcgccggccacagattggtgcgctcacgtacccgcctcctacggcaggaccagtaagcggaaagcggaggcctggcgcccgctgtgattggccgattttaaaatcccctgccaggctggccgagcggcaaaaagttcgcgctgctggtcccagcgcgggcggcccctgggctttgtgtccaccaggacagcgggccgggctccctgcaggcgcgggcggcgccgaacggtgctcagcaaccacccggacagggccaggccgttttctcccgctcaggcattagtcgttggctgtgggccgccgcgggaagttgaggcctaccacggaggaggctgctgaggtggatctcaggggatccgcaagggctccctcacccttgccgggaccctgggaacccgaaacaaaatcctacgccaccagcccgccgaatgcgccccctcggccgggggtcctgggtcttcagagaagaactcggccgaatgcggtcagaaagcccgcgaaccgcctggacctgcaggccccgccgcttggagctcccgcctttcccgaccgagcccgtgtctgctcgtgtgtctcactgatgtcttaggtctcaaaaaaaaaagaaaagaaaaggtttttagtagacagaagagaaatggggccgtgggttcgtggtcccagggggaaactgacgtcgcatgaggtcgtcgtccctcagcttgagctcagcggaacataagcttgcagaggtggaaaccacggaaggtttgggtgtcttggagctctctggacaccgaaggcccggacacagtcccggggtccgcaccgcctgtgacctgtggcgggaccgccggggtgggcgttttctcagctggcgcgcgcgtaggtggaacttgggaaactaactggagcgaagtggcaaaaaaccaagacagggccggtgacctcgcgcaggccgtccttaactgtggagtattccttcagctaacccctttatttcatgtgtccaagtctggtttctgggtttctttgtagtccctccgggcctgttcgtgcgccttcacttgcaaaaggttcgtcgtggagggccgtgtgcttgtttgcagcagtaacgatgcccttcccgagcgtgctggagtggctcctcgctgacgcaagctcaccttgcagcctcctcagcaactgcaacttaaacgcgccctcaggaagccctggaatctcgctcagtctgtcacacaggctagagtgcagtggtgagaccaccgctcattgcagcctcaacttccccgggctcaggtgattctccatgtcagcctcctgagcagctggaattacaggcacaccaccatgcccagctaatttttgtatttttagtagacacagggtctcactgtgttgcccaggaattcgagaccagcctgggtcacatagcaagaccccgtctctacaaaaaataaatttaaaaaactagccaggtgtggtgatatgcgcctgttatctcagcagctctgggggctgaggtgggaggattgcttgagcccaggagttagaagctgcagtgagctctgatggaaccactgcactatagcctggaccacagagcaggcccctgtctcaaaaataaaataaaaaagtgaaag

SEQ ID NO: 355405 - DNA, 1879 bp, Homo sapiens
cgctgattggctgtggccgcggcgggggcgggacctggcggagagcggcggattcaagatggcggcggccaggaggcggcttccagcggagccggcgggaaaaagcgagacctccgcggcggcttccgccggaccgcgtcctctcctggcagggggcggtggcgggcaccggagccgcccttaggacttcacgccagagcagctagagaagaagcccctaatgtttaccttcgtcctcccggcctccacctttctgcgccgctgctcttgctcaacttccatctccctcagactccgcgcgggccgcccggcggtgacggggctgacacagagcagccttcgctctatttacactccctcccccgcgcttgggctcgccctccccccgcgacaactgtcacgcagccgcggccccgcccccgacacgcgccgccaatcagggggctgcgtttccggtctcgcgcacgcgcgctctgggcggtgcagcctgggcggagccccgccctttacgctcgccggccacagattggtgcgctcacgtacccgcctcctacggcaggaccagtaagcggaaagcggaggcctggcgcccgctgtgattggccgattttaaaatcccctgccaggctggccgagcggcaaaaagttcgcgctgctggtcccagcgcgggcggcccctgggctttgtgtccaccaggacagcgggccgggctccctgcaggcgcgggcggcgccgaacggtgctcagcaaccacccggacagggccaggccgttttctcccgctcaggcattagtcgttggctgtgggccgccgcgggaagttgaggcctaccacggaggaggctgctgaggtggatctcaggggatccgcaagggctccctcacccttgccgggaccctgggaacccgaaacaaaatcctacgccaccagcccgccgaatgcgccccctcggccgggggtcctgggtcttcagagaagaactcggccgaatgcggtcagaaagcccgcgaaccgcctggacctgcaggccccgccgcttggagctcccgcctttcccgaccgagcccgtgtctgctcgtgtgtctcactgatgtcttaggtctcaaaaaaaaaagaaaagaaaaggtttttagtagacagaagagaaatggggccgtgggttcgtggtcccagggggaaactgacgtcgcatgaggtcgtcgtccctcagcttgagctcagcggaacataagcttgcagaggtggaaaccacggaaggtttgggtgtcttggagctctctggacaccgaaggcccggacacagtcccggggtccgcaccgcctgtgacctgtggcgggaccgccggggtgggcgttttctcagctggcgcgcgcgtaggtggaacttgggaaactaactggagcgaagtggcaaaaaaccaagacagggccggtgacctcgcgcaggccgtccttaactgtggagtattccttcagctaacccctttatttcatgtgtccaagtctggtttctgggtttctttgtagtccctccgggcctgttcgtgcgccttcacttgcaaaaggttcgtcgtggagggccgtgtgcttgtttgcagcagtaacgatgcccttcccgagcgtgctggagtggctcctcgctgacgcaagctcaccttgcagcctcctcagcaactgcaacttaaacgcgccctcaggaagccctggaatctcgctcagaattttttttctttttttgagacagtctcgctgcgacgcccaggctatagcgcaatggcgcgatctcggctccctgcaacctccctcaggaagccgtggaagctcgaccgccagaaacttccttctcctgactcaggccacagtcttctgtgtggtga

SEQ ID NO: 355406 - DNA, 2057 bp, Homo sapiens
cgctgattggctgtggccgcggcgggggcgggacctggcggagagcggcggattcaagatggcggcggccaggaggcggcttccagcggagccggcgggaaaaagcgagacctccgcggcggcttccgccggaccgcgtcctctcctggcagggggcggtggcgggcaccggagccgcccttaggacttcacgccagagcagctagagaagaagcccctaatgtttaccttcgtcctcccggcctccacctttctgcgccgctgctcttgctcaacttccatctccctcagactccgcgcgggccgcccggcggtgacggggctgacacagagcagccttcgctctatttacactccctcccccgcgcttgggctcgccctccccccgcgacaactgtcacgcagccgcggccccgcccccgacacgcgccgccaatcagggggctgcgtttccggtctcgcgcacgcgcgctctgggcggtgcagcctgggcggagccccgccctttacgctcgccggccacagattggtgcgctcacgtacccgcctcctacggcaggaccagtaagcggaaagcggaggcctggcgcccgctgtgattggccgattttaaaatcccctgccaggctggccgagcggcaaaaagttcgcgctgctggtcccagcgcgggcggcccctgggctttgtgtccaccaggacagcgggccgggctccctgcaggcgcgggcggcgccgaacggtgctcagcaaccacccggacagggccaggccgttttctcccgctcaggcattagtcgttggctgtgggccgccgcgggaagttgaggcctaccacggaggaggctgctgaggtggatctcaggggatccgcaagggctccctcacccttgccgggaccctgggaacccgaaacaaaatcctacgccaccagcccgccgaatgcgccccctcggccgggggtcctgggtcttcagagaagaactcggccgaatgcggtcagaaagcccgcgaaccgcctggacctgcaggccccgccgcttggagctcccgcctttcccgaccgagcccgtgtctgctcgtgtgtctcactgatgtcttaggtctcaaaaaaaaaagaaaagaaaaggtttttagtagacagaagagaaatggggccgtgggttcgtggtcccagggggaaactgacgtcgcatgaggtcgtcgtccctcagcttgagctcagcggaacataagcttgcagaggtggaaaccacggaaggtttgggtgtcttggagctctctggacaccgaaggcccggacacagtcccggggtccgcaccgcctgtgacctgtggcgggaccgccggggtgggcgttttctcagctggcgcgcgcgtaggtggaacttgggaaactaactggagcgaagtggcaaaaaaccaagacagggccggtgacctcgcgcaggccgtccttaactgtggagtattccttcagctaacccctttatttcatgtgtccaagtctggtttctgggtttctttgtagtccctccgggcctgttcgtgcgccttcacttgcaaaaggttcgtcgtggagggccgtgtgcttgtttgcagcagtaacgatgcccttcccgagcgtgctggagtggctcctcgctgacgcaagctcaccttgcagcctcctcagcaactgcaacttaaacgcgccctcaggaagccctggaatctcgctcagtctgtcacacaggctagagtgcagtggtgagaccaccgctcattgcagcctcaacttccccgggctcaggtgattctccatgtcagcctcctgagcagctggaattacaggcacaccaccatgcccagctaatttttgtatttttagtagacacagggtctcactgtgttgcccaggctggtcttgaactcctgggctcaagtgatccacctgccttggcctctcaaagtgctggagttacaggcatgagcaacctcgcccagcctcaattcattttaaactattaaaaagctgtcaaggccaggcaaccactgcactccaacctgggtgacagac

SEQ ID NO: 355407 - DNA, 2963 bp, Homo sapiens
ggagggaaacgtaactcccctctccttaagtgtagaccacacatagccacttcctcccaaagagtgcaataaagaaaaggagggaaagagccactttattgtggagaaaactggcagactccacctcagccaagtgacgcaggtcagcctcacagttatagtcgaggtgacagtgtgtgtccctgatgtgatggggtgacagtggcacttcacccctagatgcttcctttctgtaacctgcagtcccagtctaaccaggagataatagacacattttaattgagggacattcttcaaaatatctgcccagtactcttcgaaactgtcaaggtcatcaaaaacgaggaaagtctgagaaggagcctaaagacacataactcaatgtaatggggtgttctgatggataccacattagggacatgaggcaaacctaaggaaactgtcaaagtgtggacttcagttacttgtgtctcaatattggttcattaatcataacaaatgggccaggtgcactggctttcactcaaaaattagctgggcatgatggcacgtacctgtagtcccagctactcgagaggctgaggcagaagaatcgcttgaaactgggaagcagaggttgcagtgagccaagattgcaccattgcactctagcctgggcgtcgcagcgagactctgtctcaaaaaaaatatatatatatataacatatgtagcacactaaggtaagatgttaataagaggggaagccacacatgtggtatgtgggatctccatgtactatcttctcaattactctaaatctaaaactgttcttaaaaaccctatttaaaaaaaaagtctgacaaatccatgccctctggagcatgttatgtatactactagagatcccgaggaggcaattcttagtgcttcccattcacttggcagtcacagctgtgggcacacaggctcaagtctctccttaagtcagtcagtattacaaaccatacataatagtatacttgaccactgcataaatgttataaacattccacatcaagagaaagaggagaggaaaaaaagttaaccagttcaacgaaaaggagaatctggcaaggaagcatctctgatgtgggcagagcctgcagcagcagatgtggagggcttctcacaagtgacagcaagactgtctgtaaaacggccactttgacctggtggtgttctgctcttttcatggccatagagtactctggctggtctccaggaggtaaggcccgccctgcaggcaacaccggtgcttgggctcctgctgagcagttctttcctgcgagtaacagaaccagggagggaggtgggctgtggcctcccctgcccctacagtcgtctcctgcagctcccaccatgctggactcatcagcagcagagcaagtgacccgactgacgctgaagctcttgggacagaagctggagcaagaacggcagaacgtggaagggggacctgagggcctccacctcgagccaggaaatgaggaccggccggacgatgccctgcagactgctctgaagagaaggagggaccttctgcagagactccgggaacaacacctcctggacgagctctctcgggcccaggcctggagcgggccaagcagaggagccctcgggtcagccctgcccccagagctgccccccacgggcatcctacccactgcctccccatccccgctggccccagacccgccaaggatcatcctgcctacggtcccccagcctcctgccaccatcattcagcagctccctcagcgagccactcatagcacagattcctcctccccaggccttccctactcaacggtcaggaagtattaaggaagacatggtggagctgctgctgctgcagaacgcacaggtgcaccagttggtcctgcagaactggatgctcaaggccctgcccccagccctgcaggacccgccacatgtgcccccgagggtcccacgagctgccaggccaaggctgcctgccgtgcaccaccaccaccaccaccaccatgctgtgtggccacctggggctgccactgtcctccagcccgcccccagcctgtggacgcctggcccaccctgagtgtgagtcacagagaccctggccggggcaccctccacccccaggcttcctcagggctgtgggctgtggcgggactatggaagggagcagggagagaccctgccaccacccggagtggctacgcgagtgtggactgcaggctcctcctggggaagctgggcaggctcgctttctggtcacggggccattccagggggcatcccttgctccgggtcccctgcagtgaggggcctgtgaaccccaccagggcaacagcccctcccagggacccctcctttcctgtagggcggcgccggcccacctgggagcctcagatccccctcttccatcacggaggtaaagttgaggccgtggacgccaccagcctgatgaaataaagatttcatccagaaagagtttaagaaaatctcagctcaggagccagaacagaaaagatcaatagctttagccacatggaagtgtgaacatcctgatggggaaaataccacaaagtctaatttaataactagggacacctgtgtgccacagctgtggcacagactcccactaaagaagtaggggtgcatggctcatgcctgtaatcccagcactttaagaggctgaggcaggaggatcacttgagctcaggaattcgagaccagcctgggtcacatagcaagaccccgtctctacaaaaaataaatttaaaaaactagccaggtgtggtgatatgcgcctgttatctcagcagctctgggggctgaggtgggaggattgcttgagcccaggagttagaagctgcagtgagctctgatggaaccactgcactatagcctggaccacagagcaggcccctgtctcaaaaataaaataaaaaagtgaaag

SEQ ID NO: 355408 - DNA, 3043 bp, Homo sapiens
ggagggaaacgtaactcccctctccttaagtgtagaccacacatagccacttcctcccaaagagtgcaataaagaaaaggagggaaagagccactttattgtggagaaaactggcagactccacctcagccaagtgacgcaggtcagcctcacagttatagtcgaggtgacagtgtgtgtccctgatgtgatggggtgacagtggcacttcacccctagatgcttcctttctgtaacctgcagtcccagtctaaccaggagataatagacacattttaattgagggacattcttcaaaatatctgcccagtactcttcgaaactgtcaaggtcatcaaaaacgaggaaagtctgagaaggagcctaaagacacataactcaatgtaatggggtgttctgatggataccacattagggacatgaggcaaacctaaggaaactgtcaaagtgtggacttcagttacttgtgtctcaatattggttcattaatcataacaaatgggccaggtgcactggctttcactcaaaaattagctgggcatgatggcacgtacctgtagtcccagctactcgagaggctgaggcagaagaatcgcttgaaactgggaagcagaggttgcagtgagccaagattgcaccattgcactctagcctgggcgtcgcagcgagactctgtctcaaaaaaaatatatatatatataacatatgtagcacactaaggtaagatgttaataagaggggaagccacacatgtggtatgtgggatctccatgtactatcttctcaattactctaaatctaaaactgttcttaaaaaccctatttaaaaaaaaagtctgacaaatccatgccctctggagcatgttatgtatactactagagatcccgaggaggcaattcttagtgcttcccattcacttggcagtcacagctgtgggcacacaggctcaagtctctccttaagtcagtcagtattacaaaccatacataatagtatacttgaccactgcataaatgttataaacattccacatcaagagaaagaggagaggaaaaaaagttaaccagttcaacgaaaaggagaatctggcaaggaagcatctctgatgtgggcagagcctgcagcagcagatgtggagggcttctcacaagtgacagcaagactgtctgtaaaacggccactttgacctggtggtgttctgctcttttcatggccatagagtactctggctggtctccaggaggtaaggcccgccctgcaggcaacaccggtgcttgggctcctgctgagcagttctttcctgcgagtaacagaaccagggagggaggtgggctgtggcctcccctgcccctacagtcgtctcctgcagctcccaccatgctggactcatcagcagcagagcaagtgacccgactgacgctgaagctcttgggacagaaagcctcttagtcattcctggagcacacagggcctttgcgtggagccaccgtctctgtcacggtctctcttcctcacagaagctggagcaagaacggcagaacgtggaagggggacctgagggcctccacctcgagccaggaaatgaggaccggccggacgatgccctgcagactgctctgaagagaaggagggaccttctgcagagactccgggaacaacacctcctggacgagctctctcgggcccaggcctggagcgggccaagcagaggagccctcgggtcagccctgcccccagagctgccccccacgggcatcctacccactgcctccccatccccgctggccccagacccgccaaggatcatcctgcctacggtcccccagcctcctgccaccatcattcagcagctccctcagcgagccactcatagcacagattcctcctccccaggccttccctactcaacggtcaggaagtattaaggaagacatggtggagctgctgctgctgcagaacgcacaggtgcaccagttggtcctgcagaactggatgctcaaggccctgcccccagccctgcaggacccgccacatgtgcccccgagggtcccacgagctgccaggccaaggctgcctgccgtgcaccaccaccaccaccaccaccatgctgtgtggccacctggggctgccactgtcctccagcccgcccccagcctgtggacgcctggcccaccctgagtgtgagtcacagagaccctggccggggcaccctccacccccaggcttcctcagggctgtgggctgtggcgggactatggaagggagcagggagagaccctgccaccacccggagtggctacgcgagtgtggactgcaggctcctcctggggaagctgggcaggctcgctttctggtcacggggccattccagggggcatcccttgctccgggtcccctgcagtgaggggcctgtgaaccccaccagggcaacagcccctcccagggacccctcctttcctgtagggcggcgccggcccacctgggagcctcagatccccctcttccatcacggaggtaaagttgaggccgtggacgccaccagcctgatgaaataaagatttcatccagaaagagtttaagaaaatctcagctcaggagccagaacagaaaagatcaatagctttagccacatggaagtgtgaacatcctgatggggaaaataccacaaagtctaatttaataactagggacacctgtgtgccacagctgtggcacagactcccactaaagaagtaggggtgcatggctcatgcctgtaatcccagcactttaagaggctgaggcaggaggatcacttgagctcaggaattcgagaccagcctgggtcacatagcaagaccccgtctctacaaaaaataaatttaaaaaactagccaggtgtggtgatatgcgcctgttatctcagcagctctgggggctgaggtgggaggattgcttgagcccaggagttagaagctgcagtgagctctgatggaaccactgcactatagcctggaccacagagcaggcccctgtctcaaaaataaaataaaaaagtgaaag

SEQ ID NO: 355409 - DNA, 2454 bp, Homo sapiens
ggagggaaacgtaactcccctctccttaagtgtagaccacacatagccacttcctcccaaagagtgcaataaagaaaaggagggaaagagccactttattgtggagaaaactggcagactccacctcagccaagtgacgcaggtcagcctcacagttatagtcgaggtgacagtgtgtgtccctgatgtgatggggtgacagtggcacttcacccctagatgcttcctttctgtaacctgcagtcccagtctaaccaggagataatagacacattttaattgagggacattcttcaaaatatctgcccagtactcttcgaaactgtcaaggtcatcaaaaacgaggaaagtctgagaaggagcctaaagacacataactcaatgtaatggggtgttctgatggataccacattagggacatgaggcaaacctaaggaaactgtcaaagtgtggacttcagttacttgtgtctcaatattggttcattaatcataacaaatgggccaggtgcactggctttcactcaaaaattagctgggcatgatggcacgtacctgtagtcccagctactcgagaggctgaggcagaagaatcgcttgaaactgggaagcagaggttgcagtgagccaagattgcaccattgcactctagcctgggcgtcgcagcgagactctgtctcaaaaaaaatatatatatatataacatatgtagcacactaaggctggtctccaggaggtaaggcccgccctgcaggcaacaccggtgcttgggctcctgctgagcagttctttcctgcgagtaacagaaccagggagggaggtgggctgtggcctcccctgcccctacagtcgtctcctgcagctcccaccatgctggactcatcagcagcagagcaagtgacccgactgacgctgaagctcttgggacagaagctggagcaagaacggcagaacgtggaagggggacctgagggcctccacctcgagccaggaaatgaggaccggccggacgatgccctgcagactgctctgaagagaaggagggaccttctgcagagactccgggaacaacacctcctggacgagctctctcgggcccaggcctggagcgggccaagcagaggagccctcgggtcagccctgcccccagagctgccccccacgggcatcctacccactgcctccccatccccgctggccccagacccgccaaggatcatcctgcctacggtcccccagcctcctgccaccatcattcagcagctccctcagcgagccactcatagcacagattcctcctccccaggccttccctactcaacggtcaggaagtattaaggaagacatggtggagctgctgctgctgcagaacgcacaggtgcaccagttggtcctgcagaactggatgctcaaggccctgcccccagccctgcaggacccgccacatgtgcccccgagggtcccacgagctgccaggccaaggctgcctgccgtgcaccaccaccaccaccaccaccatgctgtgtggccacctggggctgccactgtcctccagcccgcccccagcctgtggacgcctggcccaccctgagtgtgagtcacagagaccctggccggggcaccctccacccccaggcttcctcagggctgtgggctgtggcgggactatggaagggagcagggagagaccctgccaccacccggagtggctacgcgagtgtggactgcaggctcctcctggggaagctgggcaggctcgctttctggtcacggggccattccagggggcatcccttgctccgggtcccctgcagtgaggggcctgtgaaccccaccagggcaacagcccctcccagggacccctcctttcctgtagggcggcgccggcccacctgggagcctcagatccccctcttccatcacggaggtaaagttgaggccgtggacgccaccagcctgatgaaataaagatttcatccagaaagagtttaagaaaatctcagctcaggagccagaacagaaaagatcaatagctttagccacatggaagtgtgaacatcctgatggggaaaataccacaaagtctaatttaataactagggacacctgtgtgccacagctgtggcacagactcccactaaagaagtaggggtgcatggctcatgcctgtaatcccagcactttaagaggctgaggcaggaggatcacttgagctcaggaattcgagaccagcctgggtcacatagcaagaccccgtctctacaaaaaataaatttaaaaaactagccaggtgtggtgatatgcgcctgttatctcagcagctctgggggctgaggtgggaggattgcttgagcccaggagttagaagctgcagtgagctctgatggaaccactgcactatagcctggaccacagagcaggcccctgtctcaaaaataaaataaaaaagtgaaag

SEQ ID NO: 355410 - DNA, 424 bp, Homo sapiens
gtcccccagcctcctgccaccatcattcagcagctccctcagcgagccactcatagcacagattcctcctccccaggccttccctactcaacggtcaggaagtattaaggaaggtaagtgttccatattcatattgttgtgggttgaggaaattatctactgaaagggaaaatgttcctggaagcaggacagtcacttagggccagcttttggctgttcaacatgaaaataattttaactttaagaaatccttatataaatgatatctcacagggaaggaaacaagaggtataagaaagataactaggaggtaaaataattgggctccaattccaactcatccaatcatcatccattcaaaaaccattattaagatgcttcttttaaaataatttttagggcccggctcggtggctcacgcttg

SEQ ID NO: 355411 - DNA, 3110 bp, Homo sapiens
cgctgattggctgtggccgcggcgggggcgggacctggcggagagcggcggattcaagatggcggcggccaggaggcggcttccagcggagccggcgggaaaaagcgagacctccgcggcggcttccgccggaccgcgtcctctcctggcagggggcggtggcgggcaccggagccgcccttaggacttcacgccagagcagctagagaagaagcccctaatgtttaccttcgtcctcccggcctccacctttctgcgccgctgctcttgctcaacttccatctccctcagactccgcgcgggccgcccggcggtgacggggctgacacagagcagccttcgctctatttacactccctcccccgcgcttgggctcgccctccccccgcgacaactgtcacgcagccgcggccccgcccccgacacgcgccgccaatcagggggctgcgtttccggtctcgcgcacgcgcgctctgggcggtgcagcctgggcggagccccgccctttacgctcgccggccacagattggtgcgctcacgtacccgcctcctacggcaggaccagtaagcggaaagcggaggcctggcgcccgctgtgattggccgattttaaaatcccctgccaggctggccgagcggcaaaaagttcgcgctgctggtcccagcgcgggcggcccctgggctttgtgtccaccaggacagcgggccgggctccctgcaggcgcgggcggcgccgaacggtgctcagcaaccacccggacagggccaggccgttttctcccgctcaggcattagtcgttggctgtgggccgccgcgggaagttgaggcctaccacggaggaggctgctgaggtggatctcaggggatccgcaagggctccctcacccttgccgggaccctgggaacccgaaacaaaatcctacgccaccagcccgccgaatgcgccccctcggccgggggtcctgggtcttcagagaagaactcggccgaatgcggtcagaaagcccgcgaaccgcctggacctgcaggccccgccgcttggagctcccgcctttcccgaccgagcccgtgtctgctcgtgtgtctcactgatgtcttaggtctcaaaaaaaaaagaaaagaaaaggtttttagtagacagaagagaaatggggccgtgggttcgtggtcccagggggaaactgacgtcgcatgaggtcgtcgtccctcagcttgagctcagcggaacataagcttgcagaggtggaaaccacggaaggtttgggtgtcttggagctctctggacaccgaaggcccggacacagtcccggggtccgcaccgcctgtgacctgtggcgggaccgccggggtgggcgttttctcagctggcgcgcgcgctggtctccaggaggtaaggcccgccctgcaggcaacaccggtgcttgggctcctgctgagcagttctttcctgcgagtaacagaaccagggagggaggtgggctgtggcctcccctgcccctacagtcgtctcctgcagctcccaccatgctggactcatcagcagcagagcaagtgacccgactgacgctgaagctcttgggacagaagctggagcaagaacggcagaacgtggaagggggacctgagggcctccacctcgagccaggaaatgaggaccggccggacgatgccctgcagactgctctgaagagaaggagggaccttctgcagagactccgggaacaacacctcctggacgagctctctcgggcccaggcctggagcgggccaagcagaggagccctcgggtcagccctgcccccagagctgccccccacgggcatcctacccactgcctccccatccccgctggccccagacccgccaaggatcatcctgcctacggtcccccagcctcctgccaccatcattcagcagctccctcagcgagccactcatagcacagattcctcctccccaggccttccctactcaacggtcaggaagtattaaggaagacatggtggagctgctgctgctgcagaacgcacaggtgcaccagttggtcctgcagaactggatgctcaaggccctgcccccagccctgcaggacccgccacatgtgcccccgagggtcccacgagctgccaggccaaggctgcctgccgtgcaccaccaccaccaccaccaccatgctgtgtggccacctggggctgccactgtcctccagcccgcccccagcctgtggacgcctggcccaccctgagtgtgagtcacagagaccctggccggggcaccctccacccccaggcttcctcagggctgtgggctgtggcgggactatggaagggagcagggagagaccctgccaccacccggagtggctacgcgagtgtggactgcaggctcctcctggggaagctgggcaggctcgctttctggtcacggggccattccagggggcatcccttgctccgggtcccctgcagtgaggggcctgtgaaccccaccagggcaacagcccctcccagggacccctcctttcctgtagggcggcgccggcccacctgggagcctcagatccccctcttccatcacggaggtaaagttgaggccgtggacgccaccagcctgatgaaataaagatttcatccagaaagagtttaagaaaatctcagctcaggagccagaacagaaaagatcaatagctttagccacatggaagtgtgaacatcctgatggggaaaataccacaaagtctaatttaataactagggacacctgtgtgccacagctgtggcacagactcccactaaagaagtaggggtgcatggctcatgcctgtaatcccagcactttaagaggctgaggcaggaggatcacttgagctcaggaattcgagaccagcctgggtcacatagcaagaccccgtctctacaaaaaataaatttaaaaaactagccaggtgtggtgatatgcgcctgttatctcagcagctctgggggctgaggtgggaggattgcttgagcccaggagttagaagctgcagtgagctctgatggaaccactgcactatagcctggaccacagagcaggcccctgtctcaaaaataaaataaaaaagtgaaag

SEQ ID NO: 355412 - DNA, 2676 bp, Homo sapiens
cgctgattggctgtggccgcggcgggggcgggacctggcggagagcggcggattcaagatggcggcggccaggaggcggcttccagcggagccggcgggaaaaagcgagacctccgcggcggcttccgccggaccgcgtcctctcctggcagggggcggtggcgggcaccggagccgcccttaggacttcacgccagagcagctagagaagaagcccctaatgtttaccttcgtcctcccggcctccacctttctgcgccgctgctcttgctcaacttccatctccctcagactccgcgcgggccgcccggcggtgacggggctgacacagagcagccttcgctctatttacactccctcccccgcgcttgggctcgccctccccccgcgacaactgtcacgcagccgcggccccgcccccgacacgcgccgccaatcagggggctgcgtttccggtctcgcgcacgcgcgctctgggcggtgcagcctgggcggagccccgccctttacgctcgccggccacagattggtgcgctcacgtacccgcctcctacggcaggaccagtaagcggaaagcggaggcctggcgcccgctgtgattggccgattttaaaatcccctgccaggctggccgagcggcaaaaagttcgcgctgctggtcccagcgcgggcggcccctgggctttgtgtccaccaggacagcgggccgggctccctgcaggcgcgggcggcgccgaacggtgctcagcaaccacccggacagggccaggccgttttctcccgctcaggcattagtcgttggctgtgggccgccgcgggaagttgaggcctaccacggaggaggctgctgaggtggatctcaggggatccgcaagggctccctcacccttgccgggaccctgggaacccgaaacaaaatcctacgccaccagcccgccgaatgcgccccctcggccgggggtcctgggtcttcagagaagaactcggccgaatgcggtcagaaagcccgcgaaccgcctggacctgcaggccccgccgcttggagctcccgcctttcccgaccgagcccgtgtctgctcgtgtgtctcactgatgtcttaggtctcaaaaaaaaaagaaaagaaaaggtttttagtagacagaagagaaatggggccgtgggttcgtggtcccagggggaaactgacgtcgcatgaggtcgtcgtccctcagcttgagctcagcggaacataagcttgcagaggtggaaaccacggaaggtttgggtgtcttggagctctctggacaccgaaggcccggacacagtcccggggtccgcaccgcctgtgacctgtggcgggaccgccggggtgggcgttttctcagctggcgcgcgcgctggtctccaggaggtaaggcccgccctgcaggcaacaccggtgcttgggctcctgctgagcagttctttcctgcgagtaacagaaccagggagggaggtgggctgtggcctcccctgcccctacagtcgtctcctgcagctcccaccatgctggactcatcagcagcagagcaagtgacccgactgacgctgaagctcttgggacagaagctggagcaagaacggcagaacgtggaagggggacctgagggcctccacctcgagccaggaaatgaggaccggccggacgatgccctgcagactgctctgaagagaaggagggaccttctgcagagactccgggaacaacacctcctggacgagctctctcgggcccaggcctggagcgggccaagcagaggagccctcgggtcagccctgcccccagagctgccccccacgggcatcctacccactgcctccccatccccgctggccccagacccgccaaggatcatcctgcctacggtcccccagcctcctgccaccatcattcagcagctccctcagcgagccactcatagcacagattcctcctccccaggccttccctactcaacggtcaggaagtattaaggaagacatggtggagctgctgctgctgcagaacgcacaggtgcaccagttggtcctgcagaactggatgctcaaggccctgcccccagccctgcaggacccgccacatgtgcccccgagggtcccacgagctgccaggccaaggctgcctgccgtgcaccaccaccaccaccaccaccatgctgtgtggccacctggggctgccactgtcctccagcccgcccccagcctgtggacgcctggcccaccctgagttttgcaggtaggagacaggatgaccagagagttgccactgagctgcagagctccccagggacagccacctggtgctgacatggacgggcaggtgtgaacaccgaagggcccagcgcagctactggcagtaacactcacttctctcagaaccatcttttcgtgcctcttgaaggtgattccagagactctgtgctctcgttaaaagctcaaaccaaagctcagactccatttcctcttttcaaggtgactttccagcatggcatttctttctttctattaaaaatgtttttttttgagacagagttttgctcttgtcgcccaggctggagtgcaatggagcgatctcggctcactgcaagctccgcctcccaggatggtcttgatttcctgacctcgtgatccacctgcctcggcctcccaaagtgctg

SEQ ID NO: 355413 - DNA, 1289 bp, Homo sapiens
gtagatactggagacactttcttcaaggacatatgcagatagctaatcacctggctgttcctaggtcccccagcctcctgccaccatcattcagcagctccctcagcgagccactcatagcacagattcctcctccccaggccttccctactcaacggtcaggaagtattaaggaagacatggtggagctgctgctgctgcagaacgcacaggtgcaccagttggtcctgcagaactggatgctcaaggccctgcccccagccctgcaggacccgccacatgtgcccccgagggtcccacgagctgccaggccaaggctgcctgccgtgcaccaccaccaccaccaccaccatgctgtgtggccacctggggctgccactgtcctccagcccgcccccagcctgtggacgcctggcccaccctgagtgtgagtcacagagaccctggccggggcaccctccacccccaggcttcctcagggctgtgggctgtggcgggactatggaagggagcagggagagaccctgccaccacccggagtggctacgcgagtgtggactgcaggctcctcctggggaagctgggcaggctcgctttctggtcacggggccattccagggggcatcccttgctccgggtcccctgcagtgaggggcctgtgaaccccaccagggcaacagcccctcccagggacccctcctttcctgtagggcggcgccggcccacctgggagcctcagatccccctcttccatcacggaggtaaagttgaggccgtggacgccaccagcctgatgaaataaagatttcatccagaaagagtttaagaaaatctcagctcaggagccagaacagaaaagatcaatagctttagccacatggaagtgtgaacatcctgatggggaaaataccacaaagtctaatttaataactagggacacctgtgtgccacagctgtggcacagactcccactaaagaagtaggggtgcatggctcatgcctgtaatcccagcactttaagaggctgaggcaggaggatcacttgagctcaggaattcgagaccagcctgggtcacatagcaagaccccgtctctacaaaaaataaatttaaaaaactagccaggtgtggtgatatgcgcctgttatctcagcagctctgggggctgaggtgggaggattgcttgagcccaggagttagaagctgcagtgagctctgatggaaccactgcactatagcctggaccacagagcaggcccctgtctcaaaaataaaataaaaaagtgaaag

SEQ ID NO: 355414 - DNA, 524 bp, Homo sapiens
tcagtttgtgtacttttttttttaaggtcatggaagctgaagattggaaaagcaaatagaagaaaataaattcttcagcttggagataagcaggaaacccaaagaacatgttcttaagtataagacctcagtaataatattgaatagaaattcaactaaatggagctgacagaagcccagacaggcaaccaggagattcttgtggcctgcccctgtttcatcttctgccatgagtaaaagctccctgaggcctcctgaagccgagcaaatgctgacactgttttctgtacagcctgcagagctatgaacgtgtctctgctgcaaggcaccgggccctttcgctctgcagaactgcacttgcaagaccattatcaactcctaatcccagctcagaaagggagcctctgcgactcattcatcgccctccagactttctccagtcaatccttggcatcctacagagatggtcttcctcagtcttcagtctctgtaacgataccagcccttgtttagagacccagagt

SEQ ID NO: 355415 - DNA, 750 bp, Homo sapiens
aacctgaaaaccttctttgtaatgttttggggagctcagaggcttttgtgaaacaggcagatattcaaatttgtttagaaatgtttcattttaactatatttacttagtttaaggaagtatttgttgaatatttgctacatgtttagcatcatactagaagttctaagtgtcatattaacaaagatgcacaaaaggtaatgcctgcctccaagaaacttccaaatatcatccaaataatacatttattcctcacagtcatctcaaattataaatcacattaaggtttattgcatcaccattagccctttgattatcaaaattatataatcctttagataatttaattgaccattattacttagagccagtatttggattaaaaagataacccaattttttattactattacagggcataatttcattggcttggcaggtatataagaattaaaatattacagtggataaactgctttgggtgttacatatacaaactcattgacattccgttggtttgtgttacaaatgtgaaggctttcttaccaaaaaaaagtgtatgtatgtgtatgtatatatatatgtattcatacacataatatatacatatatatatatttatttgttttccaatagcggaatgtcacaatcaaaggagtagaaaattcaagttatcttgttgctctggacaagttaaatccatacactctatatacttttcggattcgttgttctactgaaactttctggaa

SEQ ID NO: 355416 - DNA, 5268 bp, Homo sapiens
agatcttggaacgagacgacctgctctctctcccagaacgtgtctctgctgcaaggcaccgggccctttcgctctgcagaactgcacttgcaagaccattatcaactcctaatcccagctcagaaagggagcctctgcgactcattcatcgccctccaggactgactgcattgcacagatgatggatatttacgtatgtttgaaacgaccatcctggatggtggacaataaaagaatgaggactgcttcaaatttccagtggctgttatcaacatttattcttctatatctaatgaatcaagtaaatagccagaaaaagggggctcctcatgatttgaagtgtgtaactaacaatttgcaagtgtggaactgttcttggaaagcaccctctggaacaggccgtggtactgattatgaagtttgcattgaaaacaggtcccgttcttgttatcagttggagaaaaccagtattaaaattccagctctttcacatggtgattatgaaataacaataaattctctacatgattttggaagttctacaagtaaattcacactaaatgaacaaaacgtttccttaattccagatactccagagatcttgaatttgtctgctgatttctcaacctctacattatacctaaagtggaacgacaggggttcagtttttccacaccgctcaaatgttatctgggaaattaaagttctacgtaaagagagtatggagctcgtaaaattagtgacccacaacacaactctgaatggcaaagatacacttcatcactggagttgggcctcagatatgcccttggaatgtgccattcattttgtggaaattagatgctacattgacaatcttcatttttctggtctcgaagagtggagtgactggagccctgtgaagaacatttcttggatacctgattctcagactaaggtttttcctcaagataaagtgatacttgtaggctcagacataacattttgttgtgtgagtcaagaaaaagtgttatcagcactgattggccatacaaactgccccttgatccatcttgatggggaaaatgttgcaatcaagattcgtaatatttctgtttctgcaagtagtggaacaaatgtagtttttacaaccgaagataacatatttggaaccgttatttttgctggatatccaccagatactcctcaacaactgaattgtgagacacatgatttaaaagaaattatatgtagttggaatccaggaagggtgacagcgttggtgggcccacgtgctacaagctacactttagttgaaagtttttcaggaaaatatgttagacttaaaagagctgaagcacctacaaacgaaagctatcaattattatttcaaatgcttccaaatcaagaaatatataattttactttgaatgctcacaatccgctgggtcgatcacaatcaacaattttagttaatataactgaaaaagtttatccccatactcctacttcattcaaagtgaaggatattaattcaacagctgttaaactttcttggcatttaccaggcaactttgcaaagattaattttttatgtgaaattgaaattaagaaatctaattcagtacaagagcagcggaatgtcacaatcaaaggagtagaaaattcaagttatcttgttgctctggacaagttaaatccatacactctatatacttttcggattcgttgttctactgaaactttctggaaatggagcaaatggagcaataaaaaacaacatttaacaacagaagccagtccttcaaaggggcctgatacttggagagagtggagttctgatggaaaaaatttaataatctattggaagcctttacccattaatgaagctaatggaaaaatactttcctacaatgtatcgtgttcatcagatgaggaaacacagtccctttctgaaatccctgatcctcagcacaaagcagagatacgacttgataagaatgactacatcatcagcgtagtggctaaaaattctgtgggctcatcaccaccttccaaaatagcgagtatggaaattccaaatgatgatctcaaaatagaacaagttgttgggatgggaaaggggattctcctcacctggcattacgaccccaacatgacttgcgactacgtcattaagtggtgtaactcgtctcggtcggaaccatgccttatggactggagaaaagttccctcaaacagcactgaaactgtaatagaatctgatgagtttcgaccaggtataagatataattttttcctgtatggatgcagaaatcaaggatatcaattattacgctccatgattggatatatagaagaattggctcccattgttgcaccaaattttactgttgaggatacttctgcagattcgatattagtaaaatgggaagacattcctgtggaagaacttagaggctttttaagaggatatttgttttactttggaaaaggagaaagagacacatctaagatgagggttttagaatcaggtcgttctgacataaaagttaagaatattactgacatatcccagaagacactgagaattgctgatcttcaaggtaaaacaagttaccacctggtcttgcgagcctatacagatggtggagtgggcccggagaagagtatgtatgtggtgacaaaggaaaattctgtgggattaattattgccattctcatcccagtggcagtggctgtcattgttggagtggtgacaagtatcctttgctatcggaaacgagaatggattaaagaaaccttctaccctgatattccaaatccagaaaactgtaaagcattacagtttcaaaagagtgtctgtgagggaagcagtgctcttaaaacattggaaatgaatccttgtaccccaaataatgttgaggttctggaaactcgatcagcatttcctaaaatagaagatacagaaataatttccccagtagctgagcgtcctgaagatcgctctgatgcagagcctgaaaaccatgtggttgtgtcctattgtccacccatcattgaggaagaaataccaaacccagccgcagatgaagctggagggactgcacaggttatttacattgatgttcagtcgatgtatcagcctcaagcaaaaccagaagaagaacaagaaaatgaccctgtaggaggggcaggctataagccacagatgcacctccccattaattctactgtggaagatatagctgcagaagaggacttagataaaactgcgggttacagacctcaggccaatgtaaatacatggaatttagtgtctccagactctcctagatccatagacagcaacagtgagattgtctcatttggaagtccatgctccattaattcccgacaatttttgattcctcctaaagatgaagactctcctaaatctaatggaggagggtggtcctttacaaacttttttcagaacaaaccaaacgattaacagtgtcaccgtgtcacttcagtcagccatctcaataagctcttactgctagtgttgctacatcagcactgggcattcttggagggatcctgtgaagtattgttaggaggtgaacttcactacatgttaagttacactgaaagtgttcatgtgcttttaatgtagtctaaaagccaaagtatagtgactcagaatcctcaatccacaaaactcaagattgggagctctttgtgatcaagccaaagaattctcatgtactctaccttcaagaagcatttcaaggctaatacctacttgtacgtacatgtaaaacaaatcccgccgcaactgttttctgttctgttgtttgtggttttctcatatgtatacttggtggaattgtaagtggatttgcaggccagggagaaaatgtccaagtaacaggtgaagtttatttgcctgacgtttactcctttctagatgaaaaccaagcacagattttaaaacttctaagattattctcctctatccacagcattcacaaaaattaatataatttttaatgtagtgacagcgatttagtgttttgtttgataaagtatgcttatttctgtgcctactgtataatggttatcaaacagttgtctcaggggtacaaactttgaaaacaagtgtgacactgaccagcccaaatcataatcatgttttcttgctgtgataggttttgcttgccttttcattattttttagcttttatgcttgcttccattatttcagttggttgccctaatatttaaaatttacacttctaagactagagacccacattttttaaaaatcattttattttgtgatacagtgacagctttatatgagcaaattcaatattattcataagcatgtaattccagtgacttactatgtgagatgactactaagcaatatctagcagcgttagttccatatagttctgattggatttcgttcctcctgaggagaccatgccgttgagcttggctacccaggcagtggtgatctttgacaccttctggtggatgttcctcccactcatgagtcttttcatcatgccacattatctgatccagtcctcacatttttaaatataaaactaaagagagaatgcttcttacaggaacagttacccaagggctgtttcttagtaactgtcataaactgatctgaatccatgggcatacctgtgttgcaggtgcagcaattgcttggtgagctgtgcagaattgattgccttcagcacagcatcctctgcccacccttgtttctcataagcgatgtctggagtgattgtggttcttggaaaagcagaaggaaaaactaaaaagtgtatcttgtattttccctgccctcaggttgcctatgtattttaccttttcatatttaaggcaaaagtacttgaaaattttaagtgtccgaataagatatgtcttttttgtttgttttttttggttgtttgtttgttttttatcatctgagattctgtaatgtatttgcaaataatggatcaattaattttttttgaagctcatattgtatctttttaaaaaccatgttgtggaaaaaagccagagtgacaagtgacaaaatctatttaggttctctgtgtatgaatcctgattttaactgctaggattcagctaaatttctgagctttatgatctgtggaaatttggaatgaaatgcaattcattttgtacatacatagtatattaaaactatataatagttcatagaaatgttcagtaatgaaaaatatatccaatcagagccatccctaaaga

SEQ ID NO: 355417 - DNA, 2056 bp, Homo sapiens
  misc_feature (2001)..(2001): n is a, c, g, or t
  misc_feature (2015)..(2015): n is a, c, g, or t
  misc_feature (2048)..(2048): n is a, c, g, or t
agatcttggaacgagacgacctgctctctctcccagaacgtgtctctgctgcaaggcaccgggccctttcgctctgcagaactgcacttgcaagaccattatcaactcctaatcccagctcagaaagggagcctctgcgactcattcatcgccctccaggactgactgcattgcacagatgatggatatttacgtatgtttgaaacgaccatcctggatggtggacaataaaagaatgaggactgcttcaaatttccagtggctgttatcaacatttattcttctatatctaatgaatcaagtaaatagccagaaaaagggggctcctcatgatttgaagtgtgtaactaacaatttgcaagtgtggaactgttcttggaaagcaccctctggaacaggccgtggtactgattatgaagtttgcattgaaaacaggtcccgttcttgttatcagttggagaaaaccagtattaaaattccagctctttcacatggtgattatgaaataacaataaattctctacatgattttggaagttctacaagtaaattcacactaaatgaacaaaacgtttccttaattccagatactccagagatcttgaatttgtctgctgatttctcaacctctacattatacctaaagtggaacgacaggggttcagtttttccacaccgctcaaatgttatctgggaaattaaagttctacgtaaagagagtatggagctcgtaaaattagtgacccacaacacaactctgaatggcaaagatacacttcatcactggagttgggcctcagatatgcccttggaatgtgccattcattttgtggaaattagatgctacattgacaatcttcatttttctggtctcgaagagtggagtgactggagccctgtgaagaacatttcttggatacctgattctcagactaaggtttttcctcaagataaagtgatacttgtaggctcagacataacattttgttgtgtgagtcaagaaaaagtgttatcagcactgattggccatacaaactgccccttgatccatcttgatggggaaaatgttgcaatcaagattcgtaatatttctgtttctgcaagtagtggaacaaatgtagtttttacaaccgaagataacatatttggaaccgttatttttgctggatatccaccagatactcctcaacaactgaattgtgagacacatgatttaaaagaaattatatgtagttggaatccaggaagggtgacagcgttggtgggcccacgtgctacaagctacactttagttgaaagtttttcaggaaaatatgttagacttaaaagagctgaagcacctacaaacgaaagctatcaattattatttcaaatgcttccaaatcaagaaatatataattttactttgaatgctcacaatccgctgggtcgatcacaatcaacaattttagttaatataactgaaaaagtttatccccatactcctacttcattcaaagtgaaggatattaattcaacagctgttaaactttcttggcatttaccaggcaactttgcaaagattaattttttatgtgaaattgaaattaagaaatctaattcagtacaagagcagcggaatgtcacaatcaaaggagtagaaaattcaagttatcttgttgctctggacaagttaaatccatacactctatatacttttcggattcgttgttctactgaaactttctggaaatggagcaaatggagcaataaaaaacaacatttaacaacagaagccagtccttcaaaggggcctgatacttggagagagtggagttctgatggaaaaaatttaataatctattggaagcctttacccattaatgaagctaatggaaaaatactttcctacaatgtatcgtgttcatcagatgaggaaacacagtccctttctgaaatccctgatcctcagcacaaagcagagatacgacttgataaggaaatggcctaccttcattcaancgtaatggggcttnaaaaaattctgggggggccttcaattaacccanccttttcc

SEQ ID NO: 355418 - DNA, 678 bp, Homo sapiens
actacatagagatataaattccatcttcaaaatagcaataaaaatatctgattttttacagtaaagaaatactttataaatgaatgtgtgtattatccaaagagcttctaactttttggtgcacaaattactgtagctaactttattattggctatatgtaaactatttttaaattaaaatctgaggtttcagtggtcatatgaatttgaattttttcaaatatctttctcaaaatttgtaaaatcaagaaggaacgtaaatgaaatcatacatgtttcacattttcagcgttaataaaaaagaaaaaaactcataaactttaaattacatgtaaatagagtaatgcttcaattctgaaaatgctagggctaggactaggtagaagtgaatgagacactactcttgaggtgaaatttaggtatgccccagaaccttagtaatcaagataaataggctgggcatggtggctcatgcctgtaatcccagcactttgggaggccgaggcggggggatcacctgagatcgggagtttgagaccagcctagctaacatggtggaaccccgtctctactaaaaacacaaaaattagtgggacgtggtggcgtaagcctgtaattccagctacttaggaggctgaggcaggagaattgtttgaaccccccaaaaaaaagaaaaaa

SEQ ID NO: 355419 - DNA, 451 bp, Homo sapiens
gtgtgtttcttgtccgtctccctccagtggaatggatgctctttgagggcagggttatttgcctctttgctctgtaaattatccagggcaaaaaaaatgctggcacttagtagatgctcaaaatatacttgtcaaatatattgaaagatttttttaataatgaaagcttttagcaagcctgggactgattcatgccatagctttctatatgggagacaccatctaacaaaatctaaagacttttactagaaaaacaaacaaatgtgtgggactaaatgcaaagcacaagtaaaagcaagaaaactgttctctcccagcccatagctctagccctgtatgtattggagaagaaaaaggattagctgttagaacctcaactaagctttgccagaggaagagggaaacagcagatgggaagaaaatattggaggcatactccagtgttgcagag

SEQ ID NO: 355420 - DNA, 4976 bp, Homo sapiens
gcggtacgggggtggtgccgcgctcctggccccgcgcgggcggacggcggaggcgcctcccagcctgctatgggatggatgaagaagagaaccactatgtctcgcagctcagggaagtctacagcagctgcgacaccacggggactggctttctggaccgccaggagctgacccagctctgccttaagcttcacctggagcagcagctgcccgtcctcctgcagacgcttctcggaaacgaccatttcgccagggttaactttgaggaatttaaggaaggttttgtggctgtgttgtcttcaaatgctggtgttcgcccctcagatgaagacagtagttctttggaatcagctgcctccagtgccatccctccaaagtatgtgaatggttctaagtggtatggccgtcggagccggcctgagctatgtgacgctgccacagaagccagacgcgtgccggagcagcaaacccaggccagcctgaaaagtcacctctggcgctcagcgtctctggagagcgtggagagtcccaagtcagatgaagaggccgagagcactaaagaagctcagaatgaattatttgaagcacaaggacagctgcagacctgggattctgaggactttgggagcccccagaagtcctgcagcccctcctttgacaccccagagagccagatccggggcgtgtgggaagagctgggggtgggcagcagcggacacctgagcgagcaggagctggctgtggtctgccagagcgtcgggctccagggactcgagaaagaggaactcgaagacctgtttaacaaactggatcaagacggagacggcaaagtgagtcttgaggaattccagcttggcctcttcagtcatgagcccgcgctacttctagagtcttccactcgggttaaaccgagcaaggcttggtctcattaccaggtcccagaggagagcggctgccacaccaccacaacctcatccctcgtgtccctgtgctccagcctgcgcctcttctccagcattgacgatggttctggcttcgcttttcctgatcaggtcctggccatgtggacccaggaggggattcagaatggcagggagatcttgcagagcctggacttcagcgtggacgagaaggtgaaccttctggagctgacctgggcccttgacaacgagctcatgacagtggacagtgccgtccagcaggcagccctggcctgctaccaccaggagctgagctaccagcaagggcaggtggagcagctggcaagggagcgtgacaaggcaaggcaggacctggagagggccgagaagaggaacctggagtttgtgaaagagatggacgactgccactccaccctggagcagctcacggagaagaaaatcaagcatctggagcaggggtaccgggaaaggctgagcctcctgcggtctgaggtggaggcggagcgagagctgttctgggagcaggcccacaggcagagggccgcgctggagtgggacgtggggcgcctgcaggctgaggaggctggcctccgcgagaagctgaccctggccctgaaggaaaacagtcgcctacagaaggagattgtggaagtggtggaaaagctttcggattcggagaggctggccctgaagctgcagaaggacctggagtttgtgctgaaggacaagctggagccacagagtgcagagctcctggcccaggaggagcggttcgcagcagtcctgaaggaatacgagctcaagtgccgggacctgcaggaccgcaacgatgagctgcaagctgagctggaaggcctgtgggcgcggctgcccaagaaccggcacagcccctcatggagcccggatgggcgcagacggcagctccctggactcggcccagcaggcatttcattcctgggtaattctgctccagtgagtatagaaacggagctgatgatggagcaggtaaaggagcattaccaagacctcaggacccagctggagaccaaggtaaattactacgaaagggaaattgcggcactgaaaaggaactttgagaaggagaggaaggacatggagcaggctcgcaggcgcgaggtcagcgtgctggagggtcagaaggccgacctggaggagctccacgagaagtctcaggaggtcatctggggcctgcaggagcagctgcaggacacagcccgcggccccgagcctgagcagatgggcctggcaccctgctgcacccaggcactgtgtggcctggccctgcggcatcacagccacctgcagcagatcaggagagaggctgaggcggagctgagtggagagctgtcggggctgggagccctgcccgctcgcagagacctgaccttggagctggaggagccgccgcagggacccctgccacgcgggagccagaggtcggagcagctggagctggagagggcactgaagctgcagccctgtgcgagcgagaagcgcgcccagatgtgcgtatcgttggccctcgaggaggaggagttggagcttgcccgcgggaagcgagtggacgggccctccctggaagcagagatgcaggccctgccgaaagatgggctggtggcaggaagtggccaggagggcacacgtggcctcctaccactgcgtccgggctgtggggagcggccactggcctggctggccccaggtgatggcagagagtctgaggaggcggcaggagccgggcctcgccgcaggcaagcccaggacacagaagctacgcagagcccggcccccgcccctgccccggcatcccacggcccctcagagaggtggtcacgcatgcagccctgtggagtggatggggatattgtcccaaaggagccagagcctttcggcgcgagcgcagcggggctggagcagcctggagcccgggagctgcctctgctgggaacagagagagacgcctcgcaaacccagccacggatgccacccctgaggccggccgcttcgtgcaggggacaggctgagaggctacaggccattcaggaagagcgagcacgaagctggagcaggggcacccaggagcaggcctcggagcagcaggcccgggccgagggcgccctggagcctgggtgtcacaagcacagtgtggaggttgccaggagagggtccttgccatcccacctccagctcgcagacccgcagggttcctggcaggagcagcttgctgccccagaagagggggagaccaaaatagcgctggagagagagaaggatgacatggaaaccaaacttctacatctggaagacgtcgtccgggctctggagaaacatgtagatttgagagagaacgacagactggagttccatagactttctgaagaaaacactttgttgaaaaacgatctgggaagggttcggcaagagcttgaagctgcagaaagtactcacgatgcacagaggaaggaaattgaggttttaaagaaagacaaggaaaaggcctgctctgagatggaggtgctcaacagacagaatcagaactacaaggatcaattatcccagctcaatgtcagggttcttcaactgggacaggaggcttctacccaccaggcccaaaacgaggagcatcgtgtgaccattcagatgttaacacagagcctggaggaggtggttcgcagtgggcagcagcaggagtgaccaaatccaaaaacttagagttgaacttgaatgcctgaatcaggaacatcagagcctgcagctgccatggtcagagctgacccagacccttgaggaaagtcaagaccaggtgcagggagctcacctgaggctgaggcaggcccaggcccagcacttgcaggaggtccggctggtgccccaggaccgtgtggccgagctgcatcgcctgctcagccttcagggagagcaggccaggaggcgcctggatgcacagcgggaagaacatgagaaacagctgaaagccacagaagagcgggtggaagaggcggagatgattctgaagaatatggaaatgctcctccaagagaaagtggataagctgaaggagcagtttgaaaagaacacgaagtccgacctgctgctgaaggagctgtacgtggagaacgcccacctggtgagagcacttcaggccaccgaggagaagcagcgaggcgccgagaaacaaagccgcctcttggaagaaaaagttcgcgctctcaacaaactcgtcagtaggattgcccccgcagccctctctgtgtaaagacagattattttctaggattcattcgaaagcacatcttttaaattaagccactgtgctgccttagattccgtgggtcatgagccatgagtcctgggacatctgaggattgggattctttgttcaccccgcagatagttaatgaatggtctgccctgggcaagatggaggtgggggctgggggaatatgcatgttgcagaagccggcgtttttattagcggtcctgagtaatttcccttggcaaaattcccagttttgccactctctggagccagatcctgggagctgtcagcaaggagcaggtaagtgagcagttatggacagcactttccatgtggtgcttccgaccctggctgtcagagtgaaatgtaaagtcagggctctgtacagttttgccatttcactgttctgctttaagcttagcttattagaactcttggtggagggtgcgtacacacattccagaaaaggcttcactcgctgggaacgtcaacccagcgagaaaggaggggaagccccttctccggggaccttatctgtggactcaggaatgatggtgtttattgcaaatgcacaatctttttcccattgaaatgtcatcacactggaaattgtactatatgtaaaaaaaaaaaaaaagtatagttttatatttgaaatgtatgcaaattatggccatatggctgattggaatgtactactgtaatataaaaagtcactgtatttgcaataaattcttttctattaaaattgaaat

SEQ ID NO: 355421 - DNA, 1658 bp, Homo sapiens
ttccagccctggccccaccttcccttcagcagtccgtgttgtctgggtagtctgtggccagtgtagccctgttgcagagtgaggtctccgctgaaaggagaactggcgtggtcgttgtttgaaaagaatcaggccccagcaaggttcactggaagctaacactggacgcagcagagtctgggtctgacaggaggtcagcgtcaccattttgagggtgatggacatgttttctgcactctagcactgtgtggaagcgctggctgacagcagcctggctgtccgaattccaaagaaatgggctccttctaaatattcaggtgctgctgcatactcgggagcacacgctttccttgcccttgcaggtgggggtgtccttggatggagagggtgctcctctgtgccgcgtctcagcagccccaccagagctgcctccccttccccatgcaggtgcagggagctcacctgaggctgaggcaggcccaggcccagcacttgcaggaggtccggctggtgccccaggaccgtgtggccgagctgcatcgcctgctcagccttcagggagagcaggccaggaggcgcctggatgcacagcgggaagaacatgagaaacagctgaaagccacagaagagcgggtggaagaggcggagatgattctgaagaatatggaaatgctcctccaagagaaagtggataagctgaaggagcagtttgaaaagaacacgaagtccgacctgctgctgaaggagctgtacgtggagaacgcccacctggtgagagcacttcaggccaccgaggagaagcagcgaggcgccgagaaacaaagccgcctcttggaagaaaaagttcgcgctctcaacaaactcgtcagtaggattgcccccgcagccctctctgtgtaaagacagattattttctaggattcattcgaaagcacatcttttaaattaagccactgtgctgccttagattccgtgggtcatgagccatgagtcctgggacatctgaggattgggattctttgttcaccccgcagatagttaatgaatggtctgccctgggcaagatggaggtgggggctgggggaatatgcatgttgcagaagccggcgtttttattagcggtcctgagtaatttcccttggcaaaattcccagttttgccactctctggagccagatcctgggagctgtcagcaaggagcaggtaagtgagcagttatggacagcactttccatgtggtgcttccgaccctggctgtcagagtgaaatgtaaagtcagggctctgtacagttttgccatttcactgttctgctttaagcttagcttattagaactcttggtggagggtgcgtacacacattccagaaaaggcttcactcgctgggaacgtcaacccagcgagaaaggaggggaagccccttctccggggaccttatctgtggactcaggaatgatggtgtttattgcaaatgcacaatctttttcccattgaaatgtcatcacactggaaattgtactatatgtaaaaaaaaaaaaaaagtatagttttatatttgaaatgtatgcaaattatggccatatggctgattggaatgtactactgtaatataaaaagtcactgtatttgcaataaattcttttctattaaaattgaaat

SEQ ID NO: 355422 - DNA, 4644 bp, Homo sapiens
gcggtacgggggtggtgccgcgctcctggccccgcgcgggcggacggcggaggcgcctcccagcctgctatgggatggatgaagaagagaaccactatgtctcgcagctcagggaagtctacagcagctgcgacaccacggggactggctttctggaccgccaggagctgacccagctctgccttaagcttcacctggagcagcagctgcccgtcctcctgcagacgcttctcggaaacgaccatttcgccagggttaactttgaggaatttaaggaaggttttgtggctgtgttgtcttcaaatgctggtgttcgcccctcagatgaagacagtagttctttggaatcagctgcctccagtgccatccctccaaagtatgtgaatggttctaagtggtatggccgtcggagccggcctgagctatgtgacgctgccacagaagccagacgcgtgccggagcagcaaacccaggccagcctgaaaagtcacctctggcgctcagcgtctctggagagcgtggagagtcccaagtcagatgaagaggccgagagcactaaagaagctcagaatgaattatttgaagcacaaggacagctgcagacctgggattctgaggactttgggagcccccagaagtcctgcagcccctcctttgacaccccagagagccagatccggggcgtgtgggaagagctgggggtgggcagcagcggacacctgagcgagcaggagctggctgtggtctgccagagcgtcgggctccagggactcgagaaagaggaactcgaagacctgtttaacaaactggatcaagacggagacggcaaagtgagtcttgaggaattccagcttggcctcttcagtcatgagcccgcgctacttctagagtcttccactcgggttaaaccgagcaaggcttggtctcattaccaggtcccagaggagagcggctgccacaccaccacaacctcatccctcgtgtccctgtgctccagcctgcgcctcttctccagcattgacgatggttctggcttcgcttttcctgatcaggcatctggagcaggggtaccgggaaaggctgagcctcctgcggtctgaggtggaggcggagcgagagctgttctgggagcaggcccacaggcagagggccgcgctggagtgggacgtggggcgcctgcaggctgaggaggctggcctccgcgagaagctgaccctggccctgaaggaaaacagtcgcctacagaaggagattgtggaagtggtggaaaagctttcggattcggagaggctggccctgaagctgcagaaggacctggagtttgtgctgaaggacaagctggagccacagagtgcagagctcctggcccaggaggagcggttcgcagcagtcctgaaggaatacgagctcaagtgccgggacctgcaggaccgcaacgatgagctgcaagctgagctggaaggcctgtgggcgcggctgcccaagaaccggcacagcccctcatggagcccggatgggcgcagacggcagctccctggactcggcccagcaggcatttcattcctgggtaattctgctccagtgagtatagaaacggagctgatgatggagcaggtaaaggagcattaccaagacctcaggacccagctggagaccaaggtaaattactacgaaagggaaattgcggcactgaaaaggaactttgagaaggagaggaaggacatggagcaggctcgcaggcgcgaggtcagcgtgctggagggtcagaaggccgacctggaggagctccacgagaagtctcaggaggtcatctggggcctgcaggagcagctgcaggacacagcccgcggccccgagcctgagcagatgggcctggcaccctgctgcacccaggcactgtgtggcctggccctgcggcatcacagccacctgcagcagatcaggagagaggctgaggcggagctgagtggagagctgtcggggctgggagccctgcccgctcgcagagacctgaccttggagctggaggagccgccgcagggacccctgccacgcgggagccagaggtcggagcagctggagctggagagggcactgaagctgcagccctgtgcgagcgagaagcgcgcccagatgtgcgtatcgttggccctcgaggaggaggagttggagcttgcccgcgggaagcgagtggacgggccctccctggaagcagagatgcaggccctgccgaaagatgggctggtggcaggaagtggccaggagggcacacgtggcctcctaccactgcgtccgggctgtggggagcggccactggcctggctggccccaggtgatggcagagagtctgaggaggcggcaggagccgggcctcgccgcaggcaagcccaggacacagaagctacgcagagcccggcccccgcccctgccccggcatcccacggcccctcagagaggtggtcacgcatgcagccctgtggagtggatggggatattgtcccaaaggagccagagcctttcggcgcgagcgcagcggggctggagcagcctggagcccgggagctgcctctgctgggaacagagagagacgcctcgcaaacccagccacggatgccacccctgaggccggccgcttcgtgcaggggacaggctgagaggctacaggccattcaggaagagcgagcacgaagctggagcaggggcacccaggagcaggcctcggagcagcaggcccgggccgagggcgccctggagcctgggtgtcacaagcacagtgtggaggttgccaggagagggtccttgccatcccacctccagctcgcagacccgcagggttcctggcaggagcagcttgctgccccagaagagggggagaccaaaatagcgctggagagagagaaggatgacatggaaaccaaacttctacatctggaagacgtcgtccgggctctggagaaacatgtagatttgagagagaacgacagactggagttccatagactttctgaagaaaacactttgttgaaaaacgatctgggaagggttcggcaagagcttgaagctgcagaaagtactcacgatgcacagaggaaggaaattgaggttttaaagaaagacaaggaaaaggcctgctctgagatggaggtgctcaacagacagaatcagaactacaaggatcaattatcccagctcaatgtcagggttcttcaactgggacaggaggcttctacccaccaggcccaaaacgaggagcatcgtgtgaccattcagatgttaacacagagcctggaggaggtggttcgcagtgggcagcagcaggagtgaccaaatccaaaaacttagagttgaacttgaatgcctgaatcaggaacatcagagcctgcagctgccatggtcagagctgacccagacccttgaggaaagtcaagaccaggtgcagggagctcacctgaggctgaggcaggcccaggcccagcacttgcaggaggtccggctggtgccccaggaccgtgtggccgagctgcatcgcctgctcagccttcagggagagcaggccaggaggcgcctggatgcacagcgggaagaacatgagaaacagctgaaagccacagaagagcgggtggaagaggcggagatgattctgaagaatatggaaatgctcctccaagagaaagtggataagctgaaggagcagtttgaaaagaacacgaagtccgacctgctgctgaaggagctgtacgtggagaacgcccacctggtgagagcacttcaggccaccgaggagaagcagcgaggcgccgagaaacaaagccgcctcttggaagaaaaagttcgcgctctcaacaaactcgtcagtaggattgcccccgcagccctctctgtgtaaagacagattattttctaggattcattcgaaagcacatcttttaaattaagccactgtgctgccttagattccgtgggtcatgagccatgagtcctgggacatctgaggattgggattctttgttcaccccgcagatagttaatgaatggtctgccctgggcaagatggaggtgggggctgggggaatatgcatgttgcagaagccggcgtttttattagcggtcctgagtaatttcccttggcaaaattcccagttttgccactctctggagccagatcctgggagctgtcagcaaggagcaggtaagtgagcagttatggacagcactttccatgtggtgcttccgaccctggctgtcagagtgaaatgtaaagtcagggctctgtacagttttgccatttcactgttctgctttaagcttagcttattagaactcttggtggagggtgcgtacacacattccagaaaaggcttcactcgctgggaacgtcaacccagcgagaaaggaggggaagccccttctccggggaccttatctgtggactcaggaatgatggtgtttattgcaaatgcacaatctttttcccattgaaatgtcatcacactggaaattgtactatatgtaaaaaaaaaaaaaaagtatagttttatatttgaaatgtatgcaaattatggccatatggctgattggaatgtactactgtaatataaaaagtcactgtatttgcaataaattcttttctattaaaattgaaat

SEQ ID NO: 355423 - DNA, 3968 bp, Homo sapiens
gcggtacgggggtggtgccgcgctcctggccccgcgcgggcggacggcggaggcgcctcccagcctgctatgggatggatgaagaagagaaccactatgtctcgcagctcagggaagtctacagcagctgcgacaccacggggactggctttctggaccgccaggagctgacccagctctgccttaagcttcacctggagcagcagctgcccgtcctcctgcagacgcttctcggaaacgaccatttcgccagggttaactttgaggaatttaaggaaggttttgtggctgtgttgtcttcaaatgctggtgttcgcccctcagatgaagacagtagttctttggaatcagctgcctccagtgccatccctccaaagtatgtgaatggttctaagtggtatggccgtcggagccggcctgagctatgtgacgctgccacagaagccagacgcgtgccggagcagcaaacccaggccagcctgaaaagtcacctctggcgctcagcgtctctggagagcgtggagagtcccaagtcagatgaagaggccgagagcactaaagaagctcagaatgaattatttgaagcacaaggacagctgcagacctgggattctgaggactttgggagcccccagaagtcctgcagcccctcctttgacaccccagagagccagatccggggcgtgtgggaagagctgggggtgggcagcagcggacacctgagcgagcaggagctggctgtggtctgccagagcgtcgggctccagggactcgagaaagaggaactcgaagacctgtttaacaaactggatcaagacggagacggcaaagtgagtcttgaggaattccagcttggcctcttcagtcatgagcccgcgctacttctagagtcttccactcgggttaaaccgagcaaggcttggtctcattaccaggtcccagaggagagcggctgccacaccaccacaacctcatccctcgtgtccctgtgctccagcctgcgcctcttctccagcattgacgatggttctggcttcgcttttcctgatcaggtcctggccatgtggacccaggaggggattcagaatggcagggagatcttgcagagcctggacttcagcgtggacgagaaggtgaaccttctggagctgacctgggcccttgacaacgagctcatgacagtggacagtgccgtccagcaggcagccctggcctgctaccaccaggagctgagctaccagcaagggcaggtggagcagctggcaagggagcgtgacaaggcaaggcaggacctggagagggccgagaagaggaacctggagtttgtgaaagagatggacgactgccactccaccctggagcagctcacggagaagaaaatcaagcatctggagcaggggtaccgggaaaggctgagcctcctgcggtctgaggtggaggcggagcgagagctgttctgggagcaggcccacaggcagagggccgcgctggagtgggacgtggggcgcctgcaggctgaggaggctggcctccgcgagaagctgaccctggccctgaaggagcctgatgagccactggcctgtgtctcctaggaaaacagtcgcctacagaaggagattgtggaagtggtggaaaagctttcggattcggagaggctggccctgaagctgcagaaggacctggagtttgtgctgaaggacaagctggagccacagagtgcagagctcctggcccaggaggagcggttcgcagcagtcctgaaggaatacgagctcaagtgccgggacctgcaggaccgcaacgatgagctgcaagctgagctggaaggcctgtgggcgcggctgcccaagaaccggcacagcccctcatggagcccggatgggcgcagacggcagctccctggactcggcccagcaggcatttcattcctgggtaattctgctccagtgagtatagaaacggagctgatgatggagcaggtaaaggagcattaccaagacctcaggacccagctggagaccaaggtaaattactacgaaagggaaattgcggcactgaaaaggaactttgagaaggagaggaaggacatggagcaggctcgcaggcgcgaggtcagcgtgctggagggtcagaaggccgacctggaggagctccacgagaagtctcaggaggtcatctggggcctgcaggagcagctgcaggacacagcccgcggccccgagcctgagcagatgggcctggcaccctgctgcacccaggcactgtgtggcctggccctgcggcatcacagccacctgcagcagatcagactggagttccatagactttctgaagaaaacactttgttgaaaaacgatctgggaagggttcggcaagagcttgaagctgcagaaagtactcacgatgcacagaggaaggaaattgaggttttaaagaaagacaaggaaaaggcctgctctgagatggaggtgctcaacagacagaatcagaactacaaggatcaattatcccagctcaatgtcagggttcttcaactgggacaggaggcttctacccaccaggcccaaaacgaggagcatcgtgtgaccattcagatgttaacacagagcctggaggaggtggttcgcagtgggcagcagcaggagtgaccaaatccaaaaacttagagttgaacttgaatgcctgaatcaggaacatcagagcctgcagctgccatggtcagagctgacccagacccttgaggaaagtcaagaccaggtgcagggagctcacctgaggctgaggcaggcccaggcccagcacttgcaggaggtccggctggtgccccaggaccgtgtggccgagctgcatcgcctgctcagccttcagggagagcaggccaggaggcgcctggatgcacagcgggaagaacatgagaaacagctgaaagccacagaagagcgggtggaagaggcggagatgattctgaagaatatggaaatgctcctccaagagaaagtggataagctgaaggagcagtttgaaaagaacacgaagtccgacctgctgctgaaggagctgtacgtggagaacgcccacctggtgagagcacttcaggccaccgaggagaagcagcgaggcgccgagaaacaaagccgcctcttggaagaaaaagttcgcgctctcaacaaactcgtcagtaggattgcccccgcagccctctctgtgtaaagacagattattttctaggattcattcgaaagcacatcttttaaattaagccactgtgctgccttagattccgtgggtcatgagccatgagtcctgggacatctgaggattgggattctttgttcaccccgcagatagttaatgaatggtctgccctgggcaagatggaggtgggggctgggggaatatgcatgttgcagaagccggcgtttttattagcggtcctgagtaatttcccttggcaaaattcccagttttgccactctctggagccagatcctgggagctgtcagcaaggagcaggtaagtgagcagttatggacagcactttccatgtggtgcttccgaccctggctgtcagagtgaaatgtaaagtcagggctctgtacagttttgccatttcactgttctgctttaagcttagcttattagaactcttggtggagggtgcgtacacacattccagaaaaggcttcactcgctgggaacgtcaacccagcgagaaaggaggggaagccccttctccggggaccttatctgtggactcaggaatgatggtgtttattgcaaatgcacaatctttttcccattgaaatgtcatcacactggaaattgtactatatgtaaaaaaaaaaaaaaagtatagttttatatttgaaatgtatgcaaattatggccatatggctgattggaatgtactactgtaatataaaaagtcactgtatttgcaataaattcttttctattaaaattgaaat

SEQ ID NO: 355424 - DNA, 1689 bp, Homo sapiens
ttctcagcgtgacaactcagtgtccctagtgggactgagctcagctgccacggtggcaatcgctcattaatgcactcttcattggcttttctccccttccttgaagccgcagaaagtactcacgatgcacagaggaaggaaattgaggttttaaagaaagacaaggaaaaggcctgctctgagatggaggtgctcaacagacagaatcagaactacaaggatcaattatcccagctcaatgtcagggttcttcaactgggacaggaggcttctacccaccaggcccaaaacgaggagcatcgtgtgaccattcagatgttaacacagagcctggaggaggtggttcgcagtgggcagcagcaggagtgaccaaatccaaaaacttagagttgaacttgaatgcctgaatcaggaacatcagagcctgcagctgccatggtcagagctgacccagacccttgaggaaagtcaagaccaggtgcagggagctcacctgaggctgaggcaggcccaggcccagcacttgcaggaggtccggctggtgccccaggaccgtgtggccgagctgcatcgcctgctcagccttcagggagagcaggccaggaggcgcctggatgcacagcgggaagaacatgagaaacagctgaaagccacagaagagcgggtggaagaggcggagatgattctgaagaatatggaaatgctcctccaagagaaagtggataagctgaaggagcagtttgaaaagaacacgaagtccgacctgctgctgaaggagctgtacgtggagaacgcccacctggtgagagcacttcaggccaccgaggagaagcagcgaggcgccgagaaacaaagccgcctcttggaagaaaaagttcgcgctctcaacaaactcgtcagtaggattgcccccgcagccctctctgtgtaaagacagattattttctaggattcattcgaaagcacatcttttaaattaagccactgtgctgccttagattccgtgggtcatgagccatgagtcctgggacatctgaggattgggattctttgttcaccccgcagatagttaatgaatggtctgccctgggcaagatggaggtgggggctgggggaatatgcatgttgcagaagccggcgtttttattagcggtcctgagtaatttcccttggcaaaattcccagttttgccactctctggagccagatcctgggagctgtcagcaaggagcaggtaagtgagcagttatggacagcactttccatgtggtgcttccgaccctggctgtcagagtgaaatgtaaagtcagggctctgtacagttttgccatttcactgttctgctttaagcttagcttattagaactcttggtggagggtgcgtacacacattccagaaaaggcttcactcgctgggaacgtcaacccagcgagaaaggaggggaagccccttctccggggaccttatctgtggactcaggaatgatggtgtttattgcaaatgcacaatctttttcccattgaaatgtcatcacactggaaattgtactatatgtaaaaaaaaaaaaaaagtatagttttatatttgaaatgtatgcaaattatggccatatggctgattggaatgtactactgtaatataaaaagtcactgtatttgcaataaattcttttctattaaaattgaaat

SEQ ID NO: 355425 - DNA, 1686 bp, Homo sapiens
gtcacggctgcagtgaaccatgaatgtgccaccgcactccagccagggcaacagagcgagagcctgtcttgaaaaacaaaacaaaacaaaacaaaacaaatgactacttaataaaaatatagccaatgatgggcaaatgtatatataacatgaaaattaaaaacatttttttcttatgtatttaaaaactttttcccccagaatcagaactacaaggatcaattatcccagctcaatgtcagggttcttcaactgggacaggaggcttctacccaccaggcccaaaacgaggagcatcgtgtgaccattcagatgttaacacagagcctggaggaggtggttcgcagtgggcagcagcaggagtgaccaaatccaaaaacttagagttgaacttgaatgcctgaatcaggaacatcagagcctgcagctgccatggtcagagctgacccagacccttgaggaaagtcaagaccaggtgcagggagctcacctgaggctgaggcaggcccaggcccagcacttgcaggaggtccggctggtgccccaggaccgtgtggccgagctgcatcgcctgctcagccttcagggagagcaggccaggaggcgcctggatgcacagcgggaagaacatgagaaacagctgaaagccacagaagagcgggtggaagaggcggagatgattctgaagaatatggaaatgctcctccaagagaaagtggataagctgaaggagcagtttgaaaagaacacgaagtccgacctgctgctgaaggagctgtacgtggagaacgcccacctggtgagagcacttcaggccaccgaggagaagcagcgaggcgccgagaaacaaagccgcctcttggaagaaaaagttcgcgctctcaacaaactcgtcagtaggattgcccccgcagccctctctgtgtaaagacagattattttctaggattcattcgaaagcacatcttttaaattaagccactgtgctgccttagattccgtgggtcatgagccatgagtcctgggacatctgaggattgggattctttgttcaccccgcagatagttaatgaatggtctgccctgggcaagatggaggtgggggctgggggaatatgcatgttgcagaagccggcgtttttattagcggtcctgagtaatttcccttggcaaaattcccagttttgccactctctggagccagatcctgggagctgtcagcaaggagcaggtaagtgagcagttatggacagcactttccatgtggtgcttccgaccctggctgtcagagtgaaatgtaaagtcagggctctgtacagttttgccatttcactgttctgctttaagcttagcttattagaactcttggtggagggtgcgtacacacattccagaaaaggcttcactcgctgggaacgtcaacccagcgagaaaggaggggaagccccttctccggggaccttatctgtggactcaggaatgatggtgtttattgcaaatgcacaatctttttcccattgaaatgtcatcacactggaaattgtactatatgtaaaaaaaaaaaaaaagtatagttttatatttgaaatgtatgcaaattatggccatatggctgattggaatgtactactgtaatataaaaagtcactgtatttgcaataaattcttttctattaaaattgaaat

SEQ ID NO: 355426 - DNA, 2014 bp, Homo sapiens
gcggtacgggggtggtgccgcgctcctggccccgcgcgggcggacggcggaggcgcctcccagcctgctatgggatggatgaagaagagaaccactatgtctcgcagctcagggaagtctacagcagctgcgacaccacggggactggctttctggaccgccaggagctgacccagctctgccttaagcttcacctggagcagcagctgcccgtcctcctgcagacgcttctcggaaacgaccatttcgccagggttaactttgaggaatttaaggaaggttttgtggctgtgttgtcttcaaatgctggtgttcgcccctcagatgaagacagtagttctttggaatcagctgcctccagtgccatccctccaaagtatgtgaatggttctaagtggtatggccgtcggagccggcctgagctatgtgacgctgccacagaagccagacgcgtgccggagcagcaaacccaggccagcctgaaaagtcacctctggcgctcagcgtctctggagagcgtggagagtcccaagtcagatgaagaggccgagagcactaaagaagctcagaatgaattatttgaagcacaaggacagctgcagacctgggattctgaggactttgggagcccccagaagtcctgcagcccctcctttgacaccccagagagccagatccggggcgtgtgggaagagctgggggtgggcagcagcggacacctgagcgagcaggagctggctgtggtctgccagagcgtcgggctccagggactcgagaaagaggaactcgaagacctgtttaacaaactggatcaagacggagacggcaaagtgagtcttgaggaattccagcttggcctcttcagtcatgagcccgcgctacttctagagtcttccactcgggttaaaccgagcaaggcttggtctcattaccaggtcccagaggagagcggctgccacaccaccacaacctcatccctcgtgtccctgtgctccagcctgcgcctcttctccagcattgacgatggttctggcttcgcttttcctgatcaggtcctggccatgtggacccaggaggggattcagaatggcagggagatcttgcagagcctggacttcagcgtggacgagaaggtgaaccttctggagctgacctgggcccttgacaacgagctcatgacagtggacagtgccgtccagcaggcagccctggcctgctaccaccaggagctgagctaccagcaagggcaggtggagcagctggcaagggagcgtgacaaggcaaggcaggacctggagagggccgagaagaggaacctggagtttgtgaaagagatggacgactgccactccaccctggagcagctcacggagaagaaaatcaagcatctggagcaggggtaccgggaaaggctgagcctcctgcggtctgaggtggaggcggagcgagagctgttctgggagcaggcccacaggcagagggccgcgctggagtgggacgtggggcgcctgcaggctgaggaggctggcctccgcgagaagctgaccctggccctgaaggaaaacagtcgcctacagaaggagattgtggaagtggtggaaaagctttcggattcggagaggctggccctgaagctgcagaaggacctggagtttgtgctgaaggacaagctggagccacagagtgcagagctcctggcccaggaggagcggttcgcagcagtcctgaaggaatacgagctcaagtgccgggacctgcaggaccgcaacgatgagctgcaagctgagctggaaggcctgtgggcgcggctgcccaagaaccggcacagcccctcatggagcccggatgggcgcagacggcagctccctggactcggcccagcaggtaggagcccgtccctgggagggggctgacccaaggcctgctgttgacaacaaggcccagagccaggaaaagagagtggagatgatgaagatgatgatgttgctgtgacctgaagggaggtggtctgctc

SEQ ID NO: 355427 - DNA, 1802 bp, Homo sapiens
gcggtacgggggtggtgccgcgctcctggccccgcgcgggcggacggcggaggcgcctcccagcctgctatgggatggatgaagaagagaaccactatgtctcgcagctcagggaagtctacagcagctgcgacaccacggggactggctttctggaccgccaggagctgacccagctctgccttaagcttcacctggagcagcagctgcccgtcctcctgcagacgcttctcggaaacgaccatttcgccagggttaactttgaggaatttaaggaaggttttgtggctgtgttgtcttcaaatgctggtgttcgcccctcagatgaagacagtagttctttggaatcagctgcctccagtgccatccctccaaagtatgtgaatggttctaagtggtatggccgtcggagccggcctgagctatgtgacgctgccacagaagccagacgcgtgccggagcagcaaacccaggccagcctgaaaagtcacctctggcgctcagcgtctctggagagcgtggagagtcccaagtcagatgaagaggccgagagcactaaagaagctcagaatgaattatttgaagcacaaggacagctgcagacctgggattctgaggactttgggagcccccagaagtcctgcagcccctcctttgacaccccagagagccagatccggggcgtgtgggaagagctgggggtgggcagcagcggacacctgagcgagcaggagctggctgtggtctgccagagcgtcgggctccagggactcgagaaagaggaactcgaagacctgtttaacaaactggatcaagacggagacggcaaagtgagtcttgaggaattccagcttggcctcttcagtcatgagcccgcgctacttctagagtcttccactcgggttaaaccgagcaaggcttggtctcattaccaggtcccagaggagagcggctgccacaccaccacaacctcatccctcgtgtccctgtgctccagcctgcgcctcttctccagcattgacgatggttctggcttcgcttttcctgatcaggtcctggccatgtggacccaggaggggattcagaatggcagggagatcttgcagagcctggacttcagcgtggacgagaaggtgaaccttctggagctgacctgggcccttgacaacgagctcatgacagtggacagtgccgtccagcaggcagccctggcctgctaccaccaggagctgagctaccagcaagggcaggtggagcagctggcaagggagcgtgacaaggcaaggcaggacctggagagggccgagaagaggaacctggagtttgtgaaagagatggacgactgccactccaccctggagcagctcacggagaagaaaatcaagaaaacagtcgcctacagaaggagattgtggaagtggtggaaaagctttcggattcggagaggctggccctgaagctgcagaaggacctggagtttgtgctgaaggacaagctggagccacagagtgcagagctcctggcccaggaggagcggttcgcagcagtcctgaaggaatacgagctcaagtgccgggtacgtgcctgctctgtctgccttttagtctcatgtccaggctctgggtctccacacgcaggtggtccacagtaacgcaggagtgtctgctccagggagagcctctgcttgcggccatgcttgaccatggccttgccacactcctagacttagggttccctggctctcgttgccacctatcctgaaggccgcctctgtgtgtccagggaccatgcagggcattgtt

SEQ ID NO: 355428 - DNA, 5009 bp, Homo sapiens
gcggtacgggggtggtgccgcgctcctggccccgcgcgggcggacggcggaggcgcctcccagcctgctatgggatggatgaagaagagaaccactatgtctcgcagctcagggaagtctacagcagctgcgacaccacggggactggctttctggaccgccaggagctgacccagctctgccttaagcttcacctggagcagcagctgcccgtcctcctgcagacgcttctcggaaacgaccatttcgccagggttaactttgaggaatttaaggaaggttttgtggctgtgttgtcttcaaatgctggtgttcgcccctcagatgaagacagtagttctttggaatcagctgcctccagtgccatccctccaaagtatgtgaatggttctaagtggtatggccgtcggagccggcctgagctatgtgacgctgccacagaagccagacgcgtgccggagcagcaaacccaggccagcctgaaaagtcacctctggcgctcagcgtctctggagagcgtggagagtcccaagtcagatgaagaggccgagagcactaaagaagctcagaatgaattatttgaagcacaaggacagctgcagacctgggattctgaggactttgggagcccccagaagtcctgcagcccctcctttgacaccccagagagccagatccggggcgtgtgggaagagctgggggtgggcagcagcggacacctgagcgagcaggagctggctgtggtctgccagagcgtcgggctccagggactcgagaaagaggaactcgaagacctgtttaacaaactggatcaagacggagacggcaaagtgagtcttgaggaattccagcttggcctcttcagtcatgagcccgcgctacttctagagtcttccactcgggttaaaccgagcaaggcttggtctcattaccaggtcccagaggagagcggctgccacaccaccacaacctcatccctcgtgtccctgtgctccagcctgcgcctcttctccagcattgacgatggttctggcttcgcttttcctgatcaggtcctggccatgtggacccaggaggggattcagaatggcagggagatcttgcagagcctggacttcagcgtggacgagaaggtgaaccttctggagctgacctgggcccttgacaacgagctcatgacagtggacagtgccgtccagcaggcagccctggcctgctaccaccaggagctgagctaccagcaagggcaggtggagcagctggcaagggagcgtgacaaggcaaggcaggacctggagagggccgagaagaggaacctggagtttgtgaaagagatggacgactgccactccaccctggagcagctcacggagaagaaaatcaagcatctggagcaggggtaccgggaaaggctgagcctcctgcggtctgaggtggaggcggagcgagagctgttctgggagcaggcccacaggcagagggccgcgctggagtgggacgtggggcgcctgcaggctgaggaggctggcctccgcgagaagctgaccctggccctgaaggagcctgatgagccactggcctgtgtctcctaggaaaacagtcgcctacagaaggagattgtggaagtggtggaaaagctttcggattcggagaggctggccctgaagctgcagaaggacctggagtttgtgctgaaggacaagctggagccacagagtgcagagctcctggcccaggaggagcggttcgcagcagtcctgaaggaatacgagctcaagtgccgggacctgcaggaccgcaacgatgagctgcaagctgagctggaaggcctgtgggcgcggctgcccaagaaccggcacagcccctcatggagcccggatgggcgcagacggcagctccctggactcggcccagcaggcatttcattcctgggtaattctgctccagtgagtatagaaacggagctgatgatggagcaggtaaaggagcattaccaagacctcaggacccagctggagaccaaggtaaattactacgaaagggaaattgcggcactgaaaaggaactttgagaaggagaggaaggacatggagcaggctcgcaggcgcgaggtcagcgtgctggagggtcagaaggccgacctggaggagctccacgagaagtctcaggaggtcatctggggcctgcaggagcagctgcaggacacagcccgcggccccgagcctgagcagatgggcctggcaccctgctgcacccaggcactgtgtggcctggccctgcggcatcacagccacctgcagcagatcaggagagaggctgaggcggagctgagtggagagctgtcggggctgggagccctgcccgctcgcagagacctgaccttggagctggaggagccgccgcagggacccctgccacgcgggagccagaggtcggagcagctggagctggagagggcactgaagctgcagccctgtgcgagcgagaagcgcgcccagatgtgcgtatcgttggccctcgaggaggaggagttggagcttgcccgcgggaagcgagtggacgggccctccctggaagcagagatgcaggccctgccgaaagatgggctggtggcaggaagtggccaggagggcacacgtggcctcctaccactgcgtccgggctgtggggagcggccactggcctggctggccccaggtgatggcagagagtctgaggaggcggcaggagccgggcctcgccgcaggcaagcccaggacacagaagctacgcagagcccggcccccgcccctgccccggcatcccacggcccctcagagaggtggtcacgcatgcagccctgtggagtggatggggatattgtcccaaaggagccagagcctttcggcgcgagcgcagcggggctggagcagcctggagcccgggagctgcctctgctgggaacagagagagacgcctcgcaaacccagccacggatgccacccctgaggccggccgcttcgtgcaggggacaggctgagaggctacaggccattcaggaagagcgagcacgaagctggagcaggggcacccaggagcaggcctcggagcagcaggcccgggccgagggcgccctggagcctgggtgtcacaagcacagtgtggaggttgccaggagagggtccttgccatcccacctccagctcgcagacccgcagggttcctggcaggagcagcttgctgccccagaagagggggagaccaaaatagcgctggagagagagaaggatgacatggaaaccaaacttctacatctggaagacgtcgtccgggctctggagaaacatgtagatttgagagagaacgacagactggagttccatagactttctgaagaaaacactttgttgaaaaacgatctgggaagggttcggcaagagcttgaagctgcagaaagtactcacgatgcacagaggaaggaaattgaggttttaaagaaagacaaggaaaaggcctgctctgagatggaggtgctcaacagacagaatcagaactacaaggatcaattatcccagctcaatgtcagggttcttcaactgggacaggaggcttctacccaccaggcccaaaacgaggagcatcgtgtgaccattcagatgttaacacagagcctggaggaggtggttcgcagtgggcagcagcaggagtgaccaaatccaaaaacttagagttgaacttgaatgcctgaatcaggaacatcagagcctgcagctgccatggtcagagctgacccagacccttgaggaaagtcaagaccaggtgcagggagctcacctgaggctgaggcaggcccaggcccagcacttgcaggaggtccggctggtgccccaggaccgtgtggccgagctgcatcgcctgctcagccttcagggagagcaggccaggaggcgcctggatgcacagcgggaagaacatgagaaacagctgaaagccacagaagagcgggtggaagaggcggagatgattctgaagaatatggaaatgctcctccaagagaaagtggataagctgaaggagcagtttgaaaagaacacgaagtccgacctgctgctgaaggagctgtacgtggagaacgcccacctggtgagagcacttcaggccaccgaggagaagcagcgaggcgccgagaaacaaagccgcctcttggaagaaaaagttcgcgctctcaacaaactcgtcagtaggattgcccccgcagccctctctgtgtaaagacagattattttctaggattcattcgaaagcacatcttttaaattaagccactgtgctgccttagattccgtgggtcatgagccatgagtcctgggacatctgaggattgggattctttgttcaccccgcagatagttaatgaatggtctgccctgggcaagatggaggtgggggctgggggaatatgcatgttgcagaagccggcgtttttattagcggtcctgagtaatttcccttggcaaaattcccagttttgccactctctggagccagatcctgggagctgtcagcaaggagcaggtaagtgagcagttatggacagcactttccatgtggtgcttccgaccctggctgtcagagtgaaatgtaaagtcagggctctgtacagttttgccatttcactgttctgctttaagcttagcttattagaactcttggtggagggtgcgtacacacattccagaaaaggcttcactcgctgggaacgtcaacccagcgagaaaggaggggaagccccttctccggggaccttatctgtggactcaggaatgatggtgtttattgcaaatgcacaatctttttcccattgaaatgtcatcacactggaaattgtactatatgtaaaaaaaaaaaaaaagtatagttttatatttgaaatgtatgcaaattatggccatatggctgattggaatgtactactgtaatataaaaagtcactgtatttgcaataaattcttttctattaaaattgaaat

SEQ ID NO: 355429 - DNA, 3440 bp, Homo sapiens
agtgggaacagaggggcaggcacaagcagcccctctcctctcagcatccaggcccttgtgcacctggcccccacccggagctgtctctagcagcctgctcctggggagctgctgtccccgctctgcagggctcccgatctgccaatgcttggaggtggaggccctccaaccacttccttgctccccttgccctggccaggcatggaccacataccccttctggtgctgtggtcttgccagctctcacttcacttccactggactctcctgcgggccaccagaggtcccaaggcccagcagcttcagggaattaggggacagttttggctctgggtctccagcgctatcgtgtagaacccactgcagtgtgggccacgtcgtatgtctgccctgtccagttgggagccttgagggcttggaacgtggcctgcacggccgaggggctgcaaccaggtcctgcatggtggcggccatcttccatgtgaacactccacatggaaagggttcgtgcttgggcttccatgtgcagaacctcgctccgtggggcggatcctcgtctggactctgaagtagggcccagggtataggttgaagccagggctgagggaggcgaggagggataaagaaagccaaccacagagaggaggtcgcagccgttgcaacagctgggcagacttcaaacccgagagaggggctgggggcggcagggctgtggtgtgtgacggttctacttccacaggagagaggctgaggcggagctgagtggagagctgtcggggctgggagccctgcccgctcgcagagacctgaccttggagctggaggagccgccgcagggacccctgccacgcgggagccagaggtcggagcagctggagctggagagggcactgaagctgcagccctgtgcgagcgagaagcgcgcccagatgtgcgtatcgttggccctcgaggaggaggagttggagcttgcccgcgggaagcgagtggacgggccctccctggaagcagagatgcaggccctgccgaaagatgggctggtggcaggaagtggccaggagggcacacgtggcctcctaccactgcgtccgggctgtggggagcggccactggcctggctggccccaggtgatggcagagagtctgaggaggcggcaggagccgggcctcgccgcaggcaagcccaggacacagaagctacgcagagcccggcccccgcccctgccccggcatcccacggcccctcagagaggtggtcacgcatgcagccctgtggagtggatggggatattgtcccaaaggagccagagcctttcggcgcgagcgcagcggggctggagcagcctggagcccgggagctgcctctgctgggaacagagagagacgcctcgcaaacccagccacggatgccacccctgaggccggccgcttcgtgcaggggacaggctgagaggctacaggccattcaggaagagcgagcacgaagctggagcaggggcacccaggagcaggcctcggagcagcaggcccgggccgagggcgccctggagcctgggtgtcacaagcacagtgtggaggttgccaggagagggtccttgccatcccacctccagctcgcagacccgcagggttcctggcaggagcagcttgctgccccagaagagggggagaccaaaatagcgctggagagagagaaggatgacatggaaaccaaacttctacatctggaagacgtcgtccgggctctggagaaacatgtagatttgagagagaacgacagactggagttccatagactttctgaagaaaacactttgttgaaaaacgatctgggaagggttcggcaagagcttgaagctgcagaaagtactcacgatgcacagaggaaggaaattgaggttttaaagaaagacaaggaaaaggcctgctctgagatggaggtgctcaacagacagaatcagaactacaaggatcaattatcccagctcaatgtcagggttcttcaactgggacaggaggcttctacccaccaggcccaaaacgaggagcatcgtgtgaccattcagatgttaacacagagcctggaggaggtggttcgcagtgggcagcagcaggagtgaccaaatccaaaaacttagagttgaacttgaatgcctgaatcaggaacatcagagcctgcagctgccatggtcagagctgacccagacccttgaggaaagtcaagaccaggtgcagggagctcacctgaggctgaggcaggcccaggcccagcacttgcaggaggtccggctggtgccccaggaccgtgtggccgagctgcatcgcctgctcagccttcagggagagcaggccaggaggcgcctggatgcacagcgggaagaacatgagaaacagctgaaagccacagaagagcgggtggaagaggcggagatgattctgaagaatatggaaatgctcctccaagagaaagtggataagctgaaggagcagtttgaaaagaacacgaagtccgacctgctgctgaaggagctgtacgtggagaacgcccacctggtgagagcacttcaggccaccgaggagaagcagcgaggcgccgagaaacaaagccgcctcttggaagaaaaagttcgcgctctcaacaaactcgtcagtaggattgcccccgcagccctctctgtgtaaagacagattattttctaggattcattcgaaagcacatcttttaaattaagccactgtgctgccttagattccgtgggtcatgagccatgagtcctgggacatctgaggattgggattctttgttcaccccgcagatagttaatgaatggtctgccctgggcaagatggaggtgggggctgggggaatatgcatgttgcagaagccggcgtttttattagcggtcctgagtaatttcccttggcaaaattcccagttttgccactctctggagccagatcctgggagctgtcagcaaggagcaggtaagtgagcagttatggacagcactttccatgtggtgcttccgaccctggctgtcagagtgaaatgtaaagtcagggctctgtacagttttgccatttcactgttctgctttaagcttagcttattagaactcttggtggagggtgcgtacacacattccagaaaaggcttcactcgctgggaacgtcaacccagcgagaaaggaggggaagccccttctccggggaccttatctgtggactcaggaatgatggtgtttattgcaaatgcacaatctttttcccattgaaatgtcatcacactggaaattgtactatatgtaaaaaaaaaaaaaaagtatagttttatatttgaaatgtatgcaaattatggccatatggctgattggaatgtactactgtaatataaaaagtcactgtatttgcaataaattcttttctattaaaattgaaat

SEQ ID NO: 355430 - DNA, 1627 bp, Homo sapiens
gtcacggctgcagtgaaccatgaatgtgccaccgcactccagccagggcaacagagcgagagcctgtcttgaaaaacaaaacaaaacaaaacaaaacaaatgactacttaataaaaatatagccaatgatgggcaaatgtatatataacatgaaaattaaaaacatttttttcttatgtatttaaaaactttttcccccagaatcagaactacaaggatcaattatcccagctcaatgtcagggttcttcaactgggacaggaggcttctacccaccaggcccaaaacgaggagcatcgtgtgaccattcagatgttaacacagagcctggaggaggtggttcgcagtgggcagcagcaggcctgcagctgccatggtcagagctgacccagacccttgaggaaagtcaagaccaggtgcagggagctcacctgaggctgaggcaggcccaggcccagcacttgcaggaggtccggctggtgccccaggaccgtgtggccgagctgcatcgcctgctcagccttcagggagagcaggccaggaggcgcctggatgcacagcgggaagaacatgagaaacagctgaaagccacagaagagcgggtggaagaggcggagatgattctgaagaatatggaaatgctcctccaagagaaagtggataagctgaaggagcagtttgaaaagaacacgaagtccgacctgctgctgaaggagctgtacgtggagaacgcccacctggtgagagcacttcaggccaccgaggagaagcagcgaggcgccgagaaacaaagccgcctcttggaagaaaaagttcgcgctctcaacaaactcgtcagtaggattgcccccgcagccctctctgtgtaaagacagattattttctaggattcattcgaaagcacatcttttaaattaagccactgtgctgccttagattccgtgggtcatgagccatgagtcctgggacatctgaggattgggattctttgttcaccccgcagatagttaatgaatggtctgccctgggcaagatggaggtgggggctgggggaatatgcatgttgcagaagccggcgtttttattagcggtcctgagtaatttcccttggcaaaattcccagttttgccactctctggagccagatcctgggagctgtcagcaaggagcaggtaagtgagcagttatggacagcactttccatgtggtgcttccgaccctggctgtcagagtgaaatgtaaagtcagggctctgtacagttttgccatttcactgttctgctttaagcttagcttattagaactcttggtggagggtgcgtacacacattccagaaaaggcttcactcgctgggaacgtcaacccagcgagaaaggaggggaagccccttctccggggaccttatctgtggactcaggaatgatggtgtttattgcaaatgcacaatctttttcccattgaaatgtcatcacactggaaattgtactatatgtaaaaaaaaaaaaaaagtatagttttatatttgaaatgtatgcaaattatggccatatggctgattggaatgtactactgtaatataaaaagtcactgtatttgcaataaattcttttctattaaaattgaaat

SEQ ID NO: 355431 - DNA, 4955 bp, Homo sapiens
gcggtacgggggtggtgccgcgctcctggccccgcgcgggcggacggcggaggcgcctcccagcctgctatgggatggatgaagaagagaaccactatgtctcgcagctcagggaagtctacagcagctgcgacaccacggggactggctttctggaccgccaggagctgacccagctctgccttaagcttcacctggagcagcagctgcccgtcctcctgcagacgcttctcggaaacgaccatttcgccagggttaactttgaggaatttaaggaaggttttgtggctgtgttgtcttcaaatgctggtgttcgcccctcagatgaagacagtagttctttggaatcagctgcctccagtgccatccctccaaagtatgtgaatggttctaagtggtatggccgtcggagccggcctgagctatgtgacgctgccacagaagccagacgcgtgccggagcagcaaacccaggccagcctgaaaagtcacctctggcgctcagcgtctctggagagcgtggagagtcccaagtcagatgaagaggccgagagcactaaagaagctcagaatgaattatttgaagcacaaggacagctgcagacctgggattctgaggactttgggagcccccagaagtcctgcagcccctcctttgacaccccagagagccagatccggggcgtgtgggaagagctgggggtgggcagcagcggacacctgagcgagcaggagctggctgtggtctgccagagcgtcgggctccagggactcgagaaagaggaactcgaagacctgtttaacaaactggatcaagacggagacggcaaagtgagtcttgaggaattccagcttggcctcttcagtcatgagcccgcgctacttctagagtcttccactcgggttaaaccgagcaaggcttggtctcattaccaggtcccagaggagagcggctgccacaccaccacaacctcatccctcgtgtccctgtgctccagcctgcgcctcttctccagcattgacgatggttctggcttcgcttttcctgatcaggtcctggccatgtggacccaggaggggattcagaatggcagggagatcttgcagagcctggacttcagcgtggacgagaaggtgaaccttctggagctgacctgggcccttgacaacgagctcatgacagtggacagtgccgtccagcaggcagccctggcctgctaccaccaggagctgagctaccagcaagggcaggtggagcagctggcaagggagcgtgacaaggcaaggcaggacctggagagggccgagaagaggaacctggagtttgtgaaagagatggacgactgccactccaccctggagcagctcacggagaagaaaatcaagcatctggagcaggggtaccgggaaaggctgagcctcctgcggtctgaggtggaggcggagcgagagctgttctgggagcaggcccacaggcagagggccgcgctggagtgggacgtggggcgcctgcaggctgaggaggctggcctccgcgagaagctgaccctggccctgaaggagcctgatgagccactggcctgtgtctcctaggaaaacagtcgcctacagaaggagattgtggaagtggtggaaaagctttcggattcggagaggctggccctgaagctgcagaaggacctggagtttgtgctgaaggacaagctggagccacagagtgcagagctcctggcccaggaggagcggttcgcagcagtcctgaaggaatacgagctcaagtgccgggacctgcaggaccgcaacgatgagctgcaagctgagctggaaggcctgtgggcgcggctgcccaagaaccggcacagcccctcatggagcccggatgggcgcagacggcagctccctggactcggcccagcaggcatttcattcctgggtaattctgctccagtgagtatagaaacggagctgatgatggagcaggtaaaggagcattaccaagacctcaggacccagctggagaccaaggtaaattactacgaaagggaaattgcggcactgaaaaggaactttgagaaggagaggaaggacatggagcaggctcgcaggcgcgaggtcagcgtgctggagggtcagaaggccgacctggaggagctccacgagaagtctcaggaggtcatctggggcctgcaggagcagctgcaggacacagcccgcggccccgagcctgagcagatgggcctggcaccctgctgcacccaggcactgtgtggcctggccctgcggcatcacagccacctgcagcagatcaggagagaggctgaggcggagctgagtggagagctgtcggggctgggagccctgcccgctcgcagagacctgaccttggagctggaggagccgccgcagggacccctgccacgcgggagccagaggtcggagcagctggagctggagagggcactgaagctgcagccctgtgcgagcgagaagcgcgcccagatgtgcgtatcgttggccctcgaggaggaggagttggagcttgcccgcgggaagcgagtggacgggccctccctggaagcagagatgcaggccctgccgaaagatgggctggtggcaggaagtggccaggagggcacacgtggcctcctaccactgcgtccgggctgtggggagcggccactggcctggctggccccaggtgatggcagagagtctgaggaggcggcaggagccgggcctcgccgcaggcaagcccaggacacagaagctacgcagagcccggcccccgcccctgccccggcatcccacggcccctcagagaggtggtcacgcatgcagccctgtggagtggatggggatattgtcccaaaggagccagagcctttcggcgcgagcgcagcggggctggagcagcctggagcccgggagctgcctctgctgggaacagagagagacgcctcgcaaacccagccacggatgccacccctgaggccggccgcttcgtgcaggggacaggctgagaggctacaggccattcaggaagagcgagcacgaagctggagcaggggcacccaggagcaggcctcggagcagcaggcccgggccgagggcgccctggagcctgggtgtcacaagcacagtgtggaggttgccaggagagggtccttgccatcccacctccagctcgcagacccgcagggttcctggcaggagcagcttgctgccccagaagagggggagaccaaaatagcgctggagagagagaaggatgacatggaaaccaaacttctacatctggaagacgtcgtccgggctctggagaaacatgtagatttgagagagaacgacagactggagttccatagactttctgaagaaaacactttgttgaaaaacgatctgggaagggttcggcaagagcttgaagctgcagaaagtactcacgatgcacagaggaaggaaattgaggttttaaagaaagacaaggaaaaggcctgctctgagatggaggtgctcaacagacagaatcagaactacaaggatcaattatcccagctcaatgtcagggttcttcaactgggacaggaggcttctacccaccaggcccaaaacgaggagcatcgtgtgaccattcagatgttaacacagagcctggaggaggtggttcgcagtgggcagcagcaggagtgaccaaatccaaaaacttagagttgaacttgaatgcctgaatcaggaacatcagagcctgcagctgccatggtcagagctgacccagacccttgaggaaagtcaagaccaggtgcagggagctcacctgaggctgaggcaggcccaggcccagcacttgcaggaggtccggctggtgccccaggaccgtgtggccgagctgcatcgcctgctcagccttcagggagagcaggccaggaggcgcctggatgcacagcgggaagaacatgagaaacagctgaaagccacagaagagcgggtggaagaggcggagatgattctgaagaatatggaaatgctcctccaagagaaagtggataagctgaaggagcagtttgaaaagaacacgaagtccgacctgctgctgaaggagctgtacgtggagaacgcccacctggtgagagcacttcaggccaccgaggagaagcagcgaggcgccgagaaacaaagccgcctcttggaagatgtgtaaagacagattattttctaggattcattcgaaagcacatcttttaaattaagccactgtgctgccttagattccgtgggtcatgagccatgagtcctgggacatctgaggattgggattctttgttcaccccgcagatagttaatgaatggtctgccctgggcaagatggaggtgggggctgggggaatatgcatgttgcagaagccggcgtttttattagcggtcctgagtaatttcccttggcaaaattcccagttttgccactctctggagccagatcctgggagctgtcagcaaggagcaggtaagtgagcagttatggacagcactttccatgtggtgcttccgaccctggctgtcagagtgaaatgtaaagtcagggctctgtacagttttgccatttcactgttctgctttaagcttagcttattagaactcttggtggagggtgcgtacacacattccagaaaaggcttcactcgctgggaacgtcaacccagcgagaaaggaggggaagccccttctccggggaccttatctgtggactcaggaatgatggtgtttattgcaaatgcacaatctttttcccattgaaatgtcatcacactggaaattgtactatatgtaaaaaaaaaaaaaaagtatagttttatatttgaaatgtatgcaaattatggccatatggctgattggaatgtactactgtaatataaaaagtcactgtatttgcaataaattcttttctattaaaattgaaat

SEQ ID NO: 355432 - DNA, 802 bp, Homo sapiens
gagacaaagtctcactctgttgcccaggctggagtgcagtggtgcagtcttggctcactgcagcctccacttcccggttcaggcaattctcctgcctcagccacctaagtagctgggattacaggcgtgcgccagccaagcctggtgtttttagtagagactgggtttcaccatgttggccaggctggtttcgaactcctgtcctcaagtgatcgcccgcgttggcgtcccaaagtgctgggattacaggcctgagccaccacgcctggcctttagaattctttcctagacttcaagggttctctgatgttttgttttctcacccatactttaaaaacaaaatgagtaataattaggaaagctattttcctcctctgaaaaataggatctttccattgtgccacaacactcttacagtttactttctgataaaacacagagaaactttgctttcttaccacgtggtccaaggaaggaccataaaccactggagtcagccctctgggtcctccctgctcctatcctgctgctcacaggctggatggccttgagaaagacccattaatctttgtgcctgcagttttgtcaactgtcaaatagggacctgtattttataacctgaagattagtcagtctctgttctttagctttactaattgtatgttgttgctactgctctttagttctgtgtcttagaggtttatagacatctttcctgcagtcttttagttcagcaaacattttagttcaaacaattactgagagcctaagaagataaagatgagcaaggcctggtcctctg

SEQ ID NO: 355433 - DNA, 1077 bp, Homo sapiens
cgcggccaggaccggagcggaagtggcgatcggagcggaagtggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacgggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacgggtgagaaagaccctttgtgatatctaaccatagcaaaacagtgcttgtgttattaacttcattttattcctgaacatactcattgtcttggactttttttgaaagattttctgggggtgggagtgtatcttttatgagataaatacagatctgttacttttttaattcattctcaataccttctgctgactttgtttgattactgttttttgcgggtggttgtagaaagttccaggtgaatgtagttagttgtttcttaccaagctt

SEQ ID NO: 355434 - DNA, 677 bp, Homo sapiens
cggtacgggtgtatcgatgccacatcttgctgaagatggcatatggagacaacaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaggagaatcgtacgtcgactttcgatttttcaaagcctcagcctaggaaaaatggtccaggggataaacagctggtatttgtatctaaaactcagattggtcacataaatgccacggcattccgaagttttgattttgattaacattgacaggattactgtgtgtttaattttttaaaaactgaacactgtgattatggggttttgtaatttag

SEQ ID NO: 355435 - DNA, 1592 bp, Homo sapiens
cgcggccaggaccggagcggaagtggcgatcggagcggaagtggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacgggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaggaaattggacgtgaatttggattttaaaagttaagttgggaaaaggggtcccggggcgatataaaccaccgggggatattgtggtattttaaaccttcagattggcgtcaaaataattgccacggagattcccaagaaggttagattatggattaactactttggcacggagttgagcgggtttgtcacattttttaaaaccttgaacctgggcatcttatggggggcttggaaagtgagcaagacttttcgtgggtgagaaaaattttaagcctggaattttatggttgtacctttgggaagagggttactgtggtttttccaaagataattctttgggaaatacaattcctgtggtaactgttgtacagaaaggtatacagagttaattgtgggggggggaatgtgggtgggagacccactttttgggatttgactgaagcggaacttcaccagaaagtcgaggggccggattaaagaacttgctggtgggggttgcttaagtttgaccatgtgcgttctcggaaacagatctgaggac

SEQ ID NO: 355436 - DNA, 1258 bp, Homo sapiens
  misc_feature (9)..(9): n is a, c, g, or t
ggggggcancaaatacggctaggtacgaggctgggtggtagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacgggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaggagaatcgtacgtcgactttcgatttttcaaagcctcagcctaggaaaaatggtccaggggataaacagctggtatttgtatctaaaactcagattggtcacataaatgccacggcattccgaagttttgattttgattaacattgacaggattactgtgtgtttaattttttaaaaactgaacactgtgattatggggttttgtaatttag

SEQ ID NO: 355437 - DNA, 993 bp, Homo sapiens
cgcggccaggaccggagcggaagtggcgatcggagcggaagtggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacgggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtgggacatcggaaaacagggagacgaagaaaccctgtggaggagagaactatgtttttgtgcttgggaactgtcaggacactcta

SEQ ID NO: 355438 - DNA, 1163 bp, Homo sapiens
cgcggccaggaccggagcggaagtggcgatcggagcggaagtggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacgggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggcatcgataatcaccggtgtttatcgatgccacataatctggttccttgttggatttgaacagattatgtggctcgtcggggcaaaccgagggtttttatttacttggaaagaatcatcacagcccgcgaattcacaagctggatttagccattttcccttagattctgcgccatgagcctataggctgttgaatacgagagaagtgttttctaaacgagttctaaatttaccagcagtgtcaggaagaggcc

SEQ ID NO: 355439 - DNA, 1414 bp, Homo sapiens
taccgccaccgccgccgccgattccggagccggggtagtcgccgccgccgccgccgccgctgcagccactgcaggcaccgctgccgccgcctgagtagtgagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacggcagagtctccagagatttgggccgctacaaaaagtgcattttgcccattcggctgtggatagagaagcaggaagagcactggacttggagtcagggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaggagaatcgtacgtcgactttcgatttttcaaagcctcagcctaggaaaaatggtccaggggataaacagctggtatttgtatctaaaactcagattggtcacataaatgccacggcattccgaagttttgattttgattaacattgacaggattactgtgtgtttaattttttaaaaactgaacactgtgattatggggttttgtaatttag

SEQ ID NO: 355440 - DNA, 1238 bp, Homo sapiens
ggtggcggcggcggcggcggcggctgctgctgctgctgctgcccgcgtcgaggctcgcgggcggcgggcccgggtgagctgcagccactgcaggcaccgctgccgccgcctgagtagtgggcttaggaaggaagaggtcatctcgctcggagcttcgctcggaagggtctttgttccctgcagccctcccacgggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaggagaatcgtacgtcgactttcgatttttcaaagcctcagcctaggaaaaatggtccaggggataaacagctggtatttgtatctaaaactcagattggtcacataaatgccacggcattccgaagttttgattttgattaacattgacaggattactgtgtgtttaattttttaaaaactgaacactgtgattatggggttttgtaatttag

SEQ ID NO: 355441 - DNA, 1103 bp, Homo sapiens
tctttttgtcactagcgcgccattgtgttggtcccgcgattcggccattatggccgggggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaggagaatcgtacgtcgactttcgatttttcaaagcctcagcctaggaaaaatggtccaggggataaacagctggtatttgtatctaaaactcagattggtcacataaatgccacggcattccgaagttttgattttgattaacattgacaggattactgtgtgtttaattttttaaaaactgaacactgtgattatggggttttgtaatttag

SEQ ID NO: 355442 - DNA, 1043 bp, Homo sapiens
cgcggccaggaccggagcggaagtggcgatcggagcggaagtggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacgggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacgcgcatttgtgaagcatgctgaatggtactcgatgagagttttagacgccctgatatgccgttctaggggcaccccccggggctcgaaacccggacacggaccgggggagaacaagtttgtgtgtggcgagggcgtccccattccttgaaaaaaggggcgagtccggccgagcccacttttaggcaagtaaaaggcggaagaaatgtgcgggtcaacaatgtggtttatgttcgg

SEQ ID NO: 355443 - DNA, 1349 bp, Homo sapiens
cgcggccaggaccggagcggaagtggcgatcggagcggaagtggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacgggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctgtttttcaggatgccacattctaaaacaactcttcgaaaatattgctctgtatacgaagcttggactccttcagaactacttttgttgagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaggagaatcgtacgtcgactttcgatttttcaaagcctcagcctaggaaaaatggtccaggggataaacagctggtatttgtatctaaaactcagattggtcacataaatgccacggcattccgaagttttgattttgattaacattgacaggattactgtgtgtttaattttttaaaaactgaacactgtgattatggggttttgtaatttag

SEQ ID NO: 355444 - DNA, 1377 bp, Homo sapiens
ggatttctacccaggtcagattgactttaaacttagttcttggcagttttgctctattatcacctttttcctcctaaggaaagatattttttcccctttaattatagaagtaataccagtttgtgggtttaaaaatggtggggggaacaagtcagaagaatataaataagaaagtaaaaatcacttctaatcttaccacccagagaaccattattaacatactccttccaggcttttcccttatatatttgtgagcatgtacacaaatgtatcttaatgttaaaataggattcttgtggtatttataatctgctttttttccactcagatttcttttgagagcctttccattatctgtttagctctgcatcattttaaaggcctacaaaacatttcattatatggctatactttaattatcccctatggatggtcaaagtgatttttaacagaagaatacaggcatctgctgttatgacctgggctaaacaacatttagtagcttggatgaaaaattggtgtttttttaatcttccaaaaaattatttagaagcagtagtgtatatcttgaatctcaaacatagttttaacatctcgtgaataattctaaattcttaacaatgttcattttttaggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaggagaatcgtacgtcgactttcgatttttcaaagcctcagcctaggaaaaatggtccaggggataaacagctggtatttgtatctaaaactcagattggtcacataaatgccacggcattccgaagttttgattttgattaacattgacaggattactgtgtgtttaattttttaaaaactgaacactgtgattatggggttttgtaatttag

SEQ ID NO: 355445 - DNA, 1006 bp, Homo sapiens
cggtacgggtgtatcgatgccacatcttgctgaagatggcatatggagacaacaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaggaaattggacgtgaatttggattttaaaagttaagttgggaaaaggggtcccggggcgatataaaccaccgggggatattgtggtattttaaaccttcagattggcgtcaaaataattgccacggagattcccaagaaggttagattatggattaactactttggcacggagttgagcgggtttgtcacattttttaaaaccttgaacctgggcatcttatggggggcttggaaagtgagcaagacttttcgtgggtgagaaaaattttaagcctggaattttatggttgtacctttgggaagagggttactgtggtttttccaaagataattctttgggaaatacaattcctgtggtaactgttgtacagaaaggtatacagagttaattgtgggggggggaatgtgggtgggagacccactttttgggatttgactgaagcggaacttcaccagaaagtcgaggggccggattaaagaacttgctggtgggggttgcttaagtttgaccatgtgcgttctcggaaacagatctgaggac

SEQ ID NO: 355446 - DNA, 916 bp, Homo sapiens
aataatagcctatcgtgttgcaccccaaagtactgtacaagaagataagttatattcacctagcgggaaaaaaagtgggctaaactagctccagagaacttgtgaattctttgctaaaggctctttgttttaggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaggaaattggacgtgaatttggattttaaaagttaagttgggaaaaggggtcccggggcgatataaaccaccgggggatattgtggtattttaaaccttcagattggcgtcaaaataattgccacggagattcccaagaaggttagattatggattaactactttggcacggagttgagcgggtttgtcacattttttaaaaccttgaacctgggcatcttatggggggcttggaaagtgagcaagacttttcgtgggtgagaaaaattttaagcctggaattttatggttgtacctttgggaagagggttactgtggtttttccaaagataattctttgggaaatacaattcctgtggtaactgttgtacagaaaggtatacagagttaattgtgggggggggaatgtgggtgggagacccactttttgggatttgactgaagcggaacttcaccagaaagtcgaggggccggattaaagaacttgctggtgggggttgcttaagtttgaccatgtgcgttctcggaaacagatctgaggac

SEQ ID NO: 355447 - DNA, 842 bp, Homo sapiens
gcacgagtttcaggagagtttagaatttcatagtaaaagactgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaggaaattggacgtgaatttggattttaaaagttaagttgggaaaaggggtcccggggcgatataaaccaccgggggatattgtggtattttaaaccttcagattggcgtcaaaataattgccacggagattcccaagaaggttagattatggattaactactttggcacggagttgagcgggtttgtcacattttttaaaaccttgaacctgggcatcttatggggggcttggaaagtgagcaagacttttcgtgggtgagaaaaattttaagcctggaattttatggttgtacctttgggaagagggttactgtggtttttccaaagataattctttgggaaatacaattcctgtggtaactgttgtacagaaaggtatacagagttaattgtgggggggggaatgtgggtgggagacccactttttgggatttgactgaagcggaacttcaccagaaagtcgaggggccggattaaagaacttgctggtgggggttgcttaagtttgaccatgtgcgttctcggaaacagatctgaggac

SEQ ID NO: 355448 - DNA, 872 bp, Homo sapiens
aataatagcctatcgtgttgcaccccaaagtactgtacaagaagataagttatattcacctagcgggaaaaaaagtgggctaaactagctccagagaacttgtgaattctttgctaaaggctctttgttttaggcatttgatgaagcaattgctgaattggatacgctgaatgaagagtcttataaagacagcactctgatcatgcagttacttagggacaatctcactgtaagtactacttccacagggtttatagtctctttcctattcacctacttaataattcactgttatcttcaagaggggatttgtaccattaaatgtagttacagttttaagttgttaaatttgttataaatgactgctgaagttttgacctttgcaatcatccctgtctgcagtgacacaggaataattttaaactgtcgagtgagataagattatacatactgggccacttacctagggaacttttagtagccctgctttgattatacttcctttctcttgcagctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaggagaatcgtacgtcgactttcgatttttcaaagcctcagcctaggaaaaatggtccaggggataaacagctggtatttgtatctaaaactcagattggtcacataaatgccacggcattccgaagttttgattttgattaacattgacaggattactgtgtgtttaattttttaaaaactgaacactgtgattatggggttttgtaatttag

SEQ ID NO: 355449 - DNA, 773 bp, Homo sapiens
  misc_feature (12)..(12): n is a, c, g, or t
  misc_feature (21)..(21): n is a, c, g, or t
cgcggcaaaacntacggctangtcgaggccgggggttcagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaagaaaaaactccggggcttttttttcgggggggggaaaaaagggttttgaattgggacatatgggtatatagtgtggttccctggaccccatgtttttttttttacaagtgggggaaaattcgcgcaggggcccccctaatagggaagcgcggtattataatttcacagataaacgccgctttacccttgttgagtctctctctctcacacaaaaccgcagaaaagaaacaaaaaaaaaaacaaatga

SEQ ID NO: 355450 - DNA, 1263 bp, Homo sapiens
cgcggccaggaccggagcggaagtggcgatcggagcggaagtggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacgggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaggagaatcgtacgtcgactttcgatttttcaaagcctcagcctaggaaaaatggtccaggggataaacagctggtatttgtatctaaaactcagattggtcacataaatgccacggcattccgaagttttgattttgattaacattgacaggattactgtgtgtttaattttttaaaaactgaacactgtgattatggggttttgtaatttag

SEQ ID NO: 355451 - DNA, 1118 bp, Homo sapiens
cgcggccaggaccggagcggaagtggcgatcggagcggaagtggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacgggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctccctgaaataagaaacaggttgacgaaaaaaaagaacaataaaaacaaaagggggggggaaaattccggggggccattgccaccctttttggaaggggccccaaggaggata

SEQ ID NO: 355452 - DNA, 1548 bp, Homo sapiens
cgcggccaggaccggagcggaagtggcgatcggagcggaagtggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacgggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactgtaagtactacttccacagggtttatagtctctttcctattcacctacttaataattcactgttatcttcaagaggggatttgtaccattaaatgtagttacagttttaagttgttaaatttgttataaatgactgctgaagttttgacctttgcaatcatccctgtctgcagtgacacaggaataattttaaactgtcgagtgagataagattatacatactgggccacttacctagggaacttttagtagccctgctttgattatacttcctttctcttgcagctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaggagaatcgtacgtcgactttcgatttttcaaagcctcagcctaggaaaaatggtccaggggataaacagctggtatttgtatctaaaactcagattggtcacataaatgccacggcattccgaagttttgattttgattaacattgacaggattactgtgtgtttaattttttaaaaactgaacactgtgattatggggttttgtaatttag

SEQ ID NO: 355453 - DNA, 1101 bp, Homo sapiens
cgcggccaggaccggagcggaagtggcgatcggagcggaagtggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacgggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcacttcgtgggcagcgctgcccacgaagtggaataagccttcgaaaagaaattgtccttgaagcttgtatctgatatcagcactggattgtagaacttgttgctgattttgaccttgtattgaagttaactgttccccttggtatttgtttaatagcctgtacatatctttgagttcaaccttcgtacggtggtttcaca

SEQ ID NO: 355454 - DNA, 1461 bp, Homo sapiens
cgcggccaggaccggagcggaagtggcgatcggagcggaagtggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacgtgcttgttatattgaagccattttagaattggagcgctatagatcagggaggcagcctctataaaaccaggctgagcaaattcccatgatgctggttctctaggcagagtctccagagatttgggccgctacaaaaagtgcattttgcccattcggctgtggatagagaagcaggaagagcactggacttggagtcagggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaggagaatcgtacgtcgactttcgatttttcaaagcctcagcctaggaaaaatggtccaggggataaacagctggtatttgtatctaaaactcagattggtcacataaatgccacggcattccgaagttttgattttgattaacattgacaggattactgtgtgtttaattttttaaaaactgaacactgtgattatggggttttgtaatttag

SEQ ID NO: 355455 - DNA, 1139 bp, Homo sapiens
  misc_feature (30)..(30): n is a, c, g, or t
  misc_feature (35)..(35): n is a, c, g, or t
cttattcccaatgctacagaacatcattcnagatntcctgcagttttccctctatcttctcacggtactctttgttccctgcagccctcccacgggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaggagaatcgtacgtcgactttcgatttttcaaagcctcagcctaggaaaaatggtccaggggataaacagctggtatttgtatctaaaactcagattggtcacataaatgccacggcattccgaagttttgattttgattaacattgacaggattactgtgtgtttaattttttaaaaactgaacactgtgattatggggttttgtaatttag

SEQ ID NO: 355456 - DNA, 938 bp, Homo sapiens
cgcggccaggaccggagcggaagtggcgatcggagcggaagtggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacgggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacgacagcactctgatcatgcagttacttagggacaatctcactctgtgggacatcggaaaacagggagacgaagaaaccctgtggaggagagaactatgtttttgtgcttgggaactgtcaggacactcta

SEQ ID NO: 355457 - DNA, 1182 bp, Homo sapiens
aagtctgtgtttgcagctgtcccagcaccctaccataatattaggagatatgaagggtatttttgaacaggtcttgtcagcaacaaccgatcccttcaggtgctcttgtatctgctcccaggactatgccatccttataggccccccccgcgatggtcgtgccaattttccgggcctttggaagcttgtatccccttgttgtgcaaaatcgggttccaagacggcaattcctgcggcagttatccaaagagaagcctccacactggtggggcatacaccgagcacagccgagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaggaaattggacgtgaatttggattttaaaagttaagttgggaaaaggggtcccggggcgatataaaccaccgggggatattgtggtattttaaaccttcagattggcgtcaaaataattgccacggagattcccaagaaggttagattatggattaactactttggcacggagttgagcgggtttgtcacattttttaaaaccttgaacctgggcatcttatggggggcttggaaagtgagcaagacttttcgtgggtgagaaaaattttaagcctggaattttatggttgtacctttgggaagagggttactgtggtttttccaaagataattctttgggaaatacaattcctgtggtaactgttgtacagaaaggtatacagagttaattgtgggggggggaatgtgggtgggagacccactttttgggatttgactgaagcggaacttcaccagaaagtcgaggggccggattaaagaacttgctggtgggggttgcttaagtttgaccatgtgcgttctcggaaacagatctgaggac

SEQ ID NO: 355458 - DNA, 316 bp, Homo sapiens
gtgcactttgatttttaccggtcctcacagtgaccctttgctcattacaatagtaaaaaacacacccctggatggagatttaagatgccagtgagacatgtgacgtatgaacagggatgcacagccactgtgcatgagcacccagaacatgcttcccagcaacccccttgcccacctgctcatgaataatcaggtaagactcctaaaaagggatcctccctccagccggtctttgctctctcatcctcacaggcagcctaccctgactcccctcttggggcgtcctgcctattctgcacctaactttcagggtatt

SEQ ID NO: 355459 - DNA, 458 bp, Homo sapiens
ggacaatagaaacctagaagtcagggcaagctgcatcccccaaggctcaggaaagctgcccagggcagatggaatcttatctgcatgtgccctacttgcactgcagcagagggaccgcagaaggcatcctgttcagggctttaaggaactaaagcattggaaggcatcccatttctacgggagattggaatagagccctggctgttctggccagtccctgtctcagatgttgcacttccagcacattctacagttattctagagagctacaagcaagaaagaggggagtctgtgttggtacaaggccacctggggagctgtccctcagagctatcccagtactcaggagaagttacaaatgtggataagtccagagtttgaatcaagatagacctccaagataatgtctttttgtgaggatttgaagatagtctgaaacaaataagttctttttaaaa

SEQ ID NO: 355460 - DNA, 3585 bp, Homo sapiens
agccgtaaaggcgcgcgggaacatggggctgtacgctgcggtggcaggcgtgctggccggcgtggagagccgccaggctctatcaaggggctggtgtactccagcaacttccagaacgtgaagcagctgtacgcgctggtgtgcgaaacgcagcgctactccgccgtgctggatgccgtgatctccagcgccggcctcctcagtgcgaagaagctgcagccgcacctggccaagggtaggggcggggcggggaagtgaaccccgacggtcagcgctttgtcatctggtttcagccccgctgccgtgcacggcgggactggagcaagtcgctcacctgaaatgagtatgagcagaccttccctgggttacgaattgagatgggatgaaaatgctttaacttcgagtgttttgaaggattaaataaccgaagtacaaagtagtagtagcggagacagtaaggaagtcgggcgtggcggcgcgcacctgtggtcccagctactcggaaggctgaggggggaggatcacttgagcccaggagttcgaagctgcagtgagctgttatgtggccactgcacttcagcctgggcgacagatctagaccccattctaaaaaaaaacaaaaaccccaaacccacgaaagggtaatgttggcaagaagttgggtgcagaggtctactggtgaacatctgtggggaaagggtctaaggctgggaagcgagacgccaggttccgatcctgttgtgtagttaatttctggtgtggtcttgagtaaggtaccccacctttatctgtaaccatctagtcaggtgatctctttagccattccagtgcccgggctctattagagttagttctaaggcattcatacttcttgcttagggcgtttctgtctttgatccctcatccccaggtgctagtgtatgagttgttgggaaagggctttcgagggggtgggggccaatggaaggctctgttgggacggcaccaggcgaggtgttgagttggctcggctcaaggttcttcggggtgtgagctggcatgaggacctgttggaagtgggatccaggcctggtccaggtgagctggaaggagttgaggggcgggggaggtggggaactttgctcctgcctactcactgctcattgcgtcctacctacctcccagctgcctcgatttgtgcgtgtgaacactctcaagacctgctccgtttatgtagttatttcaagagacaaggtttctcctatcagggtcgggcttccaggctggatggagtgccctggcgcgatctcggctcaccgcaacctctgcctcctgggttcaagcgattctcctgcttcagccttctgagcagctgggattatgaaggggtggcctgcccctccacatctgtgggatatctcatcaggtgggacaagagactgagaaaagaaataagacacagagacaaagtatagagaaacaacaagtggctggtctctgccccgtgcctcctccactgggctcacacctgtcttattttgtcctttggtggctctgagaagcagcctctgcccctctccctttcccttactctttgtaagatcctcttccttctgccctaccatgttgcttggacaccagggtggaatagcagagaacggctgcttgtgtttgaattccagctctgccacttcgatagatttctgaactgagacatgtgactctctaggcctatttctgcatgggtcggagagtgggcgggactgctttactgagttatagtgaatgtagttttaacctaagcgcctcacatgactaactcctcatccatcaagaatgagctcagctctcacttccccactcctcacccccctgtaaagtaacctttctccaaggttatgcttcaacaggaatagctaacatttattaaattgtggcacgtaagtatcttggatatattggctcattgaatcctcacacctactattttacagagatgccagtggggcttgagattgaatcacttgcccaggctcccactgctggtaaacagtagagggggctcctgacccatcagtctggcttgacaacccattccctcaactgcggatcccggattcccttatcaccctgttgatttctccatagctgtggtaacatttgttgcatgaatggaccgttgaaatagggcctggcagggagaaattcaggaaatgaatgaatggttcttccctggcagccttgatgacttacaagccctcaaggggaagcattttctcctggactccttgatgccggagctgctggtgtttcccgcccagacagatctgcatgaacacccactgtaccgggccggacacctcattctgcaggacagggccagctgtctcccagccatgctgctggacccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcctgggttggcgtctcctgctgtgagctggctgaggaggacttcctggcggtctcccccttagatccgcgctatcgtgaggtccactatgtcctgctggatccttcctgcagtggctcgggtgagatggtgagaaggcgtggctgagggactcggaggtccacagcagcttagacctggagtcatctgttttggtcttagttctgacactttaatgggcttgggaccctggagcaaaagttctcctctgtgaggcaaggatttcaggagcgaggatttcaggactgaggcagcctgtgaagctgtgtaaccgagacacgcttttccttaggtatgccgagcagacagctggaggatcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtaccagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgagtgagtgggggcatgcttgggaggcgcaggatggtactggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccaggctgactccttcctggtgggaaaggaagatgcctgtcctctccgtggaggaccctgggccctcaccgcaggcagcagtttgcattttgaaaggttattgggtcccttcctcgggctgtgttcttgctggtgagcaaaagtgttgcctgcagaaataaaatgcagaacgtactcta

SEQ ID NO: 355461 - DNA, 2772 bp, Homo sapiens
agccgtaaaggcgcgcgggaacatggggctgtacgctgcggtggcaggcgtgctggccggcgtggagagccgccaggctctatcaaggggctggtgtactccagcaacttccagaacgtgaagcagctgtacgcgctggtgtgcgaaacgcagcgctactccgccgtgctggatgccgtgatctccagcgccggcctcctcagtgcgaagaagctgcagccgcacctggccaagggtaggggcggggcggggaagtgaaccccgacggtcagcgctttgtcatctggtttcagccccgctgccgtgcacggcgggactggagcaagtcgctcacctgaaatgagtatgagcagaccttccctgggttacgaattgagatgggatgaaaatgctttaacttcgagtgttttgaaggattaaataaccgaagtacaaagtagtagtagcggagacagtaaggaagtcgggcgtggcggcgcgcacctgtggtcccagctactcggaaggctgaggggggaggatcacttgagcccaggagttcgaagctgcagtgagctgttatgtggccactgcacttcagcctgggcgacagatctagaccccattctaaaaaaaaacaaaaaccccaaacccacgaaagggtaatgttggcaagaagttgggtgcagaggtctactggtgaacatctgtggggaaagggtctaaggctgggaagcgagacgccaggttccgatcctgttgtgtagttaatttctggtgtggtcttgagtaaggtaccccacctttatctgtaaccatctagtcaggtgatctctttagccattccagtgcccgggctctattagagttagttctaaggcattcatacttcttgcttagggcgtttctgtctttgatccctcatccccaggtgctagtgtatgagttgttgggaaagggctttcgagggggtgggggccaatggaaggctctgttgggacggcaccaggcgaggtgttgagttggctcggctcaaggttcttcggggtgtgagctggcatgaggacctgttggaagtgggatccaggcctggtccaggtgagctggaaggagttgaggggcgggggaggtggggaactttgctcctgcctactcactgctcattgcgtcctacctacctcccagctgcctcgatttgtgcgtgtgaacactctcaagacctgctccgtttatgtagttatttcaagagacaaggtttctcctatcagggtcgggcttccaggctggatggagtgccctggcgcgatctcggctcaccgcaacctctgcctcctgggttcaagcgattctcctgcttcagccttctgagcagctgggattatgaaggggtggcctgcccctccacatctgtgggatatctcatcagccttgatgacttacaagccctcaaggggaagcattttctcctggactccttgatgccggagctgctggtgtttcccgcccagacagatctgcatgaacacccactgtaccgggccggacacctcattctgcaggacagggccagctgtctcccagccatgctgctggacccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcctgggttggcgtctcctgctgtgagctggctgaggaggacttcctggcggtctcccccttagatccgcgctatcgtgaggtccactatgtcctgctggatccttcctgcagtggctcgggtgagatggtgagaaggcgtggctgagggactcggaggtccacagcagcttagacctggagtcatctgttttggtcttagttctgacactttaatgggcttgggaccctggagcaaaagttctcctctgtgaggcaaggatttcaggagcgaggatttcaggactgaggcagcctgtgaagctgtgtaaccgagacacgcttttccttaggtatgccgagcagacagctggaggatcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtaccagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgagtgagtgggggcatgcttgggaggcgcaggatggtactggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccaggctgactccttcctggtgggaaaggaagatgcctgtcctctccgtggaggaccctgggccctcaccgcaggcagcagtttgcattttgaaaggttattgggtcccttcctcgggctgtgttcttgctggtgagcaaaagtgttgcctgcagaaataaaatgcagaacgtactcta

SEQ ID NO: 355462 - DNA, 2939 bp, Homo sapiens
agccgtaaaggcgcgcgggaacatggggctgtacgctgcggtggcaggcgtgctggccggcgtggagagccgccaggctctatcaaggggctggtgtactccagcaacttccagaacgtgaagcagctgtacgcgctggtgtgcgaaacgcagcgctactccgccgtgctggatgccgtgatctccagcgccggcctcctcagtgcgaagaagctgcagccgcacctggccaagggtaggggcggggcggggaagtgaaccccgacggtcagcgctttgtcatctggtttcagccccgctgccgtgcacggcgggactggagcaagtcgctcacctgaaatgagtgctagtgtatgagttgttgggaaagggctttcgagggggtgggggccaatggaaggctctgttgggacggcaccaggcgaggtgttgagttggctcggctcaaggttcttcggggtgtgagctggcatgaggacctgttggaagtgggatccaggcctggtccagcctcccagctgcctcgatttgtgcgtgtgaacactctcaagacctgctccgtttatgtagttatttcaagagacaaggtttctcctatcagggtcgggcttccaggctggatggagtgccctggcgcgatctcggctcaccgcaacctctgcctcctgggttcaagcgattctcctgcttcagccttctgagcagctgggattatgaaggggtggcctgcccctccacatctgtgggatatctcatcaggtgggacaagagactgagaaaagaaataagacacagagacaaagtatagagaaacaacaagtggctggtctctgccccgtgcctcctccactgggctcacacctgtcttattttgtcctttggtggctctgagaagcagcctctgcccctctccctttcccttactctttgtaagatcctcttccttctgccctaccatgttgcttggacaccagggtggaatagcagagaacggctgcttgtgtttgaattccagctctgccacttcgatagatttctgaactgagacatgtgactctctaggcctatttctgcatgggtcggagagtgggcgggactgctttactgagttatagtgaatgtagttttaacctaagcgcctcacatgactaactcctcatccatcaagaatgagctcagctctcacttccccactcctcacccccctgtaaagtaacctttctccaaggttatgcttcaacaggaatagctaacatttattaaattgtggcacgtaagtatcttggatatattggctcattgaatcctcacacctactattttacagagatgccagtggggcttgagattgaatcacttgcccaggctcccactgctggtaaacagtagagggggctcctgacccatcagtctggcttgacaacccattccctcaactgcggatcccggattcccttatcaccctgttgatttctccatagctgtggtaacatttgttgcatgaatggaccgttgaaatagggcctggcagggagaaattcaggaaatgaatgaatggttcttccctggcagccttgatgacttacaagccctcaaggggaagcattttctcctggactccttgatgccggagctgctggtgtttcccgcccagacagatctgcatgaacacccactgtaccgggccggacacctcattctgcaggacagggccagctgtctcccagccatgctgctggacccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcctgggttggcgtctcctgctgtgagctggctgaggaggacttcctggcggtctcccccttagatccgcgctatcgtgaggtccactatgtcctgctggatccttcctgcagtggctcgggtgagatggtgagaaggcgtggctgagggactcggaggtccacagcagcttagacctggagtcatctgttttggtcttagttctgacactttaatgggcttgggaccctggagcaaaagttctcctctgtgaggcaaggatttcaggagcgaggatttcaggactgaggcagcctgtgaagctgtgtaaccgagacacgcttttccttaggtatgccgagcagacagctggaggatcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtaccagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgagtgagtgggggcatgcttgggaggcgcaggatggtactggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccaggctgactccttcctggtgggaaaggaagatgcctgtcctctccgtggaggaccctgggccctcaccgcaggcagcagtttgcattttgaaaggttattgggtcccttcctcgggctgtgttcttgctggtgagcaaaagtgttgcctgcagaaataaaatgcagaacgtactcta

SEQ ID NO: 355463 - DNA, 2740 bp, Homo sapiens
agactatcacatggggagaaccttggacaatacctggctttccagggcagaggtccctgcagcttttcacagtacattgtgcctctggtttattgagactagagaacggcgaagacttttaccaagcatactgcttgtaaacgttttattaacaaggcatgtcctgcacagccctagatcctttaaaccttgattccatacaacacatgtttttgtgagctcaaatttggggcaaagtcacaaattaacagcatctcagccaaccaattgttcaaggtacaggtcaaaatggaatttcttatgtcttccctttctacacagacacagtaacagtctgatctctctttcttttccctacaggattgcaggcatgcagcaccatgcctggctaattttgtatttttagtagagacgggatttctccatgttggccaggctggtctcaaactcctgacctcaggtgatctgcccaccttggcctcccaaaatgctgggattacaggcatgaaccaccgcgcccggccatgctaagtcctttcttggctccattgtgctgtccctcctgcttcctctccaggtccatctgccacagtgctacgtgcaccagcgtgccagcaacagtggctggtctctgccccgtgcctcctccactgggctcacacctgtcttattttgtcctttggtggctctgagaagcagcctctgcccctctccctttcccttactctttgtaagatcctcttccttctgccctaccatgttgcttggacaccagggtggaatagcagagaacggctgcttgtgtttgaattccagctctgccacttcgatagatttctgaactgagacatgtgactctctaggcctatttctgcatgggtcggagagtgggcgggactgctttactgagttatagtgaatgtagttttaacctaagcgcctcacatgactaactcctcatccatcaagaatgagctcagctctcacttccccactcctcacccccctgtaaagtaacctttctccaaggttatgcttcaacaggaatagctaacatttattaaattgtggcacgtaagtatcttggatatattggctcattgaatcctcacacctactattttacagagatgccagtggggcttgagattgaatcacttgcccaggctcccactgctggtaaacagtagagggggctcctgacccatcagtctggcttgacaacccattccctcaactgcggatcccggattcccttatcaccctgttgatttctccatagctgtggtaacatttgttgcatgaatggaccgttgaaatagggcctggcagggagaaattcaggaaatgaatgaatggttcttccctggcagccttgatgacttacaagccctcaaggggaagcattttctcctggactccttgatgccggagctgctggtgtttcccgcccagacagatctgcatgaacacccactgtaccgggccggacacctcattctgcaggacagggccagctgtctcccagccatgctgctggacccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcctgggttggcgtctcctgctgtgagctggctgaggaggacttcctggcggtctcccccttagatccgcgctatcgtgaggtccactatgtcctgctggatccttcctgcagtggctcgggtgagatggtgagaaggcgtggctgagggactcggaggtccacagcagcttagacctggagtcatctgttttggtcttagttctgacactttaatgggcttgggaccctggagcaaaagttctcctctgtgaggcaaggatttcaggagcgaggatttcaggactgaggcagcctgtgaagctgtgtaaccgagacacgcttttccttaggtatgccgagcagacagctggaggatcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtaccagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgagtgagtgggggcatgcttgggaggcgcaggatggtactggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccaggctgactccttcctggtgggaaaggaagatgcctgtcctctccgtggaggaccctgggccctcaccgcaggcagcagtttgcattttgaaaggttattgggtcccttcctcgggctgtgttcttgctggtgagcaaaagtgttgcctgcagaaataaaatgcagaacgtactcta

SEQ ID NO: 355464 - DNA, 2785 bp, Homo sapiens
tgtccaatcccccttcgtgagacctgtcctccgtgttgcaggtgtctacctcgccacaaggaacatgcatttagttggctgcctttgcagacttcttttttacagattgacttttccaagagtcggggacatttaggcaatccgcaagagtggaagttactttcctttaacccctgccttttgaagtctccatgtgtgcttgctgtggtcgctgagactcaaagtttaggacccccttcatgtatctctcatttttgggttcagttgcctcctgttttccaactgcattttgtgtgtgtgtgtgcccagccccagtgttcttcttccccattttgcccagatccacccacccccaccctcccagctgcctcgatttgtgcgtgtgaacactctcaagacctgctccgtttatgtagttatttcaagagacaaggtttctcctatcagggtcgggcttccaggctggatggagtgccctggcgcgatctcggctcaccgcaacctctgcctcctgggttcaagcgattctcctgcttcagccttctgagcagctgggattatgaaggggtggcctgcccctccacatctgtgggatatctcatcaggtgggacaagagactgagaaaagaaataagacacagagacaaagtatagagaaacaacaagtggctggtctctgccccgtgcctcctccactgggctcacacctgtcttattttgtcctttggtggctctgagaagcagcctctgcccctctccctttcccttactctttgtaagatcctcttccttctgccctaccatgttgcttggacaccagggtggaatagcagagaacggctgcttgtgtttgaattccagctctgccacttcgatagatttctgaactgagacatgtgactctctaggcctatttctgcatgggtcggagagtgggcgggactgctttactgagttatagtgaatgtagttttaacctaagcgcctcacatgactaactcctcatccatcaagaatgagctcagctctcacttccccactcctcacccccctgtaaagtaacctttctccaaggttatgcttcaacaggaatagctaacatttattaaattgtggcacgtaagtatcttggatatattggctcattgaatcctcacacctactattttacagagatgccagtggggcttgagattgaatcacttgcccaggctcccactgctggtaaacagtagagggggctcctgacccatcagtctggcttgacaacccattccctcaactgcggatcccggattcccttatcaccctgttgatttctccatagctgtggtaacatttgttgcatgaatggaccgttgaaatagggcctggcagggagaaattcaggaaatgaatgaatggttcttccctggcagccttgatgacttacaagccctcaaggggaagcattttctcctggactccttgatgccggagctgctggtgtttcccgcccagacagatctgcatgaacacccactgtaccgggccggacacctcattctgcaggacagggccagctgtctcccagccatgctgctggacccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcctgggttggcgtctcctgctgtgagctggctgaggaggacttcctggcggtctcccccttagatccgcgctatcgtgaggtccactatgtcctgctggatccttcctgcagtggctcgggtgagatggtgagaaggcgtggctgagggactcggaggtccacagcagcttagacctggagtcatctgttttggtcttagttctgacactttaatgggcttgggaccctggagcaaaagttctcctctgtgaggcaaggatttcaggagcgaggatttcaggactgaggcagcctgtgaagctgtgtaaccgagacacgcttttccttaggtatgccgagcagacagctggaggatcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtaccagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgagtgagtgggggcatgcttgggaggcgcaggatggtactggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccaggctgactccttcctggtgggaaaggaagatgcctgtcctctccgtggaggaccctgggccctcaccgcaggcagcagtttgcattttgaaaggttattgggtcccttcctcgggctgtgttcttgctggtgagcaaaagtgttgcctgcagaaataaaatgcagaacgtactcta

SEQ ID NO: 355465 - DNA, 2201 bp, Homo sapiens
acccaggggaggaggcacggggcagagaccagccactgttgctggcacgctggtgcacgtagcactgtggcagatggacctggagaggaagcaggagggacagcacaatggagccaagaaaggacttagcatggccgggcgcggtggctctgagaagcagcctctgcccctctccctttcccttactctttgtaagatcctcttccttctgccctaccatgttgcttggacaccagggtggaatagcagagaacggctgcttgtgtttgaattccagctctgccacttcgatagatttctgaactgagacatgtgactctctaggcctatttctgcatgggtcggagagtgggcgggactgctttactgagttatagtgaatgtagttttaacctaagcgcctcacatgactaactcctcatccatcaagaatgagctcagctctcacttccccactcctcacccccctgtaaagtaacctttctccaaggttatgcttcaacaggaatagctaacatttattaaattgtggcacgtaagtatcttggatatattggctcattgaatcctcacacctactattttacagagatgccagtggggcttgagattgaatcacttgcccaggctcccactgctggtaaacagtagagggggctcctgacccatcagtctggcttgacaacccattccctcaactgcggatcccggattcccttatcaccctgttgatttctccatagctgtggtaacatttgttgcatgaatggaccgttgaaatagggcctggcagggagaaattcaggaaatgaatgaatggttcttccctggcagccttgatgacttacaagccctcaaggggaagcattttctcctggactccttgatgccggagctgctggtgtttcccgcccagacagatctgcatgaacacccactgtaccgggccggacacctcattctgcaggacagggccagctgtctcccagccatgctgctggacccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcctgggttggcgtctcctgctgtgagctggctgaggaggacttcctggcggtctcccccttagatccgcgctatcgtgaggtccactatgtcctgctggatccttcctgcagtggctcgggtgagatggtgagaaggcgtggctgagggactcggaggtccacagcagcttagacctggagtcatctgttttggtcttagttctgacactttaatgggcttgggaccctggagcaaaagttctcctctgtgaggcaaggatttcaggagcgaggatttcaggactgaggcagcctgtgaagctgtgtaaccgagacacgcttttccttaggtatgccgagcagacagctggaggatcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtaccagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgagtgagtgggggcatgcttgggaggcgcaggatggtactggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccaggctgactccttcctggtgggaaaggaagatgcctgtcctctccgtggaggaccctgggccctcaccgcaggcagcagtttgcattttgaaaggttattgggtcccttcctcgggctgtgttcttgctggtgagcaaaagtgttgcctgcagaaataaaatgcagaacgtactcta

SEQ ID NO: 355466 - DNA, 1851 bp, Homo sapiens
agccgtaaaggcgcgcgggaacatggggctgtacgctgcggtggcaggcgtgctggccggcgtggagagccgccaggctctatcaaggggctggtgtactccagcaacttccagaacgtgaagcagctgtacgcgctggtgtgcgaaacgcagcgctactccgccgtgctggatgccgtgatctccagcgccggcctcctcagtgcgaagaagctgcagccgcacctggccaaggcctcccagctgcctcgatttgtgcgtgtgaacactctcaagacctgctccgtttatgtagttatttcaagagacaaggtttctcctatcagggtcgggcttccaggctggatggagtgccctggcgcgatctcggctcaccgcaacctctgcctcctgggttcaagcgattctcctgcttcagccttctgagcagctgggattatgaaggggtggcctgcccctccacatctgtgggatatctcatcagccttgatgacttacaagccctcaaggggaagcattttctcctggactccttgatgccggagctgctggtgtttcccgcccagacagatctgcatgaacacccactgtaccgggccggacacctcattctgcaggacagggccagctgtctcccagccatgctgctggacccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcctgggttggcgtctcctgctgtgagctggctgaggaggacttcctggcggtctcccccttagatccgcgctatcgtgaggtccactatgtcctgctggatccttcctgcagtggctcgggtgagatggtgagaaggcgtggctgagggactcggaggtccacagcagcttagacctggagtcatctgttttggtcttagttctgacactttaatgggcttgggaccctggagcaaaagttctcctctgtgaggcaaggatttcaggagcgaggatttcaggactgaggcagcctgtgaagctgtgtaaccgagacacgcttttccttaggtatgccgagcagacagctggaggatcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtaccagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgagtgagtgggggcatgcttgggaggcgcaggatggtactggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccaggctgactccttcctggtgggaaaggaagatgcctgtcctctccgtggaggaccctgggccctcaccgcaggcagcagtttgcattttgaaaggttattgggtcccttcctcgggctgtgttcttgctggtgagcaaaagtgttgcctgcagaaataaaatgcagaacgtactcta

SEQ ID NO: 355467 - DNA, 1946 bp, Homo sapiens
agccgtaaaggcgcgcgggaacatggggctgtacgctgcggtggcaggcgtgctggccggcgtggagagccgccaggctctatcaaggggctggtgtactccagcaacttccagaacgtgaagcagctgtacgcgctggtgtgcgaaacgcagcgctactccgccgtgctggatgccgtgatctccagcgccggcctcctcagtgcgaagaagctgcagccgcacctggccaagggttatgcttcaacaggaatagctaacatttattaaattgtggcacgtaagtatcttggatatattggctcattgaatcctcacacctactattttacagagatgccagtggggcttgagattgaatcacttgcccaggctcccactgctggtaaacagtagagggggctcctgacccatcagtctggcttgacaacccattccctcaactgcggatcccggattcccttatcaccctgttgatttctccatagctgtggtaacatttgttgcatgaatggaccgttgaaatagggcctggcagggagaaattcaggaaatgaatgaatggttcttccctggcagccttgatgacttacaagccctcaaggggaagcattttctcctggactccttgatgccggagctgctggtgtttcccgcccagacagatctgcatgaacacccactgtaccgggccggacacctcattctgcaggacagggccagctgtctcccagccatgctgctggacccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcctgggttggcgtctcctgctgtgagctggctgaggaggacttcctggcggtctcccccttagatccgcgctatcgtgaggtccactatgtcctgctggatccttcctgcagtggctcgggtgagatggtgagaaggcgtggctgagggactcggaggtccacagcagcttagacctggagtcatctgttttggtcttagttctgacactttaatgggcttgggaccctggagcaaaagttctcctctgtgaggcaaggatttcaggagcgaggatttcaggactgaggcagcctgtgaagctgtgtaaccgagacacgcttttccttaggtatgccgagcagacagctggaggatcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtaccagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgagtgagtgggggcatgcttgggaggcgcaggatggtactggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccaggctgactccttcctggtgggaaaggaagatgcctgtcctctccgtggaggaccctgggccctcaccgcaggcagcagtttgcattttgaaaggttattgggtcccttcctcgggctgtgttcttgctggtgagcaaaagtgttgcctgcagaaataaaatgcagaacgtactcta

SEQ ID NO: 355468 - DNA, 1366 bp, Homo sapiens
tgtaccaaagtagttcacggtatttgccccaagctaagctttccccactgcaggtgtgagatgtggatcccttagcccttggggcagagaccccaggccagttacctctgaccctgggccctttaaatataggccgtttcaatattgtgtgtcctggcttaacctgcatgttctggttgtctgtgtcagctgtgacaggcccttagctgctccgtgcatgctcagctcacccctgctctgccctctgccctaggaagatctttgcctttgacctggatgccaagcggctggcatccatggccacgctgctggcctgggttggcgtctcctgctgtgagctggctgaggaggacttcctggcggtctcccccttagatccgcgctatcgtgaggtccactatgtcctgctggatccttcctgcagtggctcgggtgagatggtgagaaggcgtggctgagggactcggaggtccacagcagcttagacctggagtcatctgttttggtcttagttctgacactttaatgggcttgggaccctggagcaaaagttctcctctgtgaggcaaggatttcaggagcgaggatttcaggactgaggcagcctgtgaagctgtgtaaccgagacacgcttttccttaggtatgccgagcagacagctggaggatcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtaccagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgagtgagtgggggcatgcttgggaggcgcaggatggtactggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccaggctgactccttcctggtgggaaaggaagatgcctgtcctctccgtggaggaccctgggccctcaccgcaggcagcagtttgcattttgaaaggttattgggtcccttcctcgggctgtgttcttgctggtgagcaaaagtgttgcctgcagaaataaaatgcagaacgtactcta

SEQ ID NO: 355469 - DNA, 3515 bp, Homo sapiens
agccgtaaaggcgcgcgggaacatggggctgtacgctgcggtggcaggcgtgctggccggcgtggagagccgccaggctctatcaaggggctggtgtactccagcaacttccagaacgtgaagcagctgtacgcgctggtgtgcgaaacgcagcgctactccgccgtgctggatgccgtgatctccagcgccggcctcctcagtgcgaagaagctgcagccgcacctggccaagggtaggggcggggcggggaagtgaaccccgacggtcagcgctttgtcatctggtttcagccccgctgccgtgcacggcgggactggagcaagtcgctcacctgaaatgagtatgagcagaccttccctgggttacgaattgagatgggatgaaaatgctttaacttcgagtgttttgaaggattaaataaccgaagtacaaagtagtagtagcggagacagtaaggaagtcgggcgtggcggcgcgcacctgtggtcccagctactcggaaggctgaggggggaggatcacttgagcccaggagttcgaagctgcagtgagctgttatgtggccactgcacttcagcctgggcgacagatctagaccccattctaaaaaaaaacaaaaaccccaaacccacgaaagggtaatgttggcaagaagttgggtgcagaggtctactggtgaacatctgtggggaaagggtctaaggctgggaagcgagacgccaggttccgatcctgttgtgtagttaatttctggtgtggtcttgagtaaggtaccccacctttatctgtaaccatctagtcaggtgatctctttagccattccagtgcccgggctctattagagttagttctaaggcattcatacttcttgcttagggcgtttctgtctttgatccctcatccccaggtgctagtgtatgagttgttgggaaagggctttcgagggggtgggggccaatggaaggctctgttgggacggcaccaggcgaggtgttgagttggctcggctcaaggttcttcggggtgtgagctggcatgaggacctgttggaagtgggatccaggcctggtccaggtgagctggaaggagttgaggggcgggggaggtggggaactttgctcctgcctactcactgctcattgcgtcctacctacctcccagctgcctcgatttgtgcgtgtgaacactctcaagacctgctccgtttatgtagttatttcaagagacaaggtttctcctatcagggtcgggcttccaggctggatggagtgccctggcgcgatctcggctcaccgcaacctctgcctcctgggttcaagcgattctcctgcttcagccttctgagcagctgggattatgaaggggtggcctgcccctccacatctgtgggatatctcatcaggtgggacaagagactgagaaaagaaataagacacagagacaaagtatagagaaacaacaagtggctggtctctgccccgtgcctcctccactgggctcacacctgtcttattttgtcctttggtggctctgagaagcagcctctgcccctctccctttcccttactctttgtaagatcctcttccttctgccctaccatgttgcttggacaccagggtggaatagcagagaacggctgcttgtgtttgaattccagctctgccacttcgatagatttctgaactgagacatgtgactctctaggcctatttctgcatgggtcggagagtgggcgggactgctttactgagttatagtgaatgtagttttaacctaagcgcctcacatgactaactcctcatccatcaagaatgagctcagctctcacttccccactcctcacccccctgtaaagtaacctttctccaaggttatgcttcaacaggaatagctaacatttattaaattgtggcacgtaagtatcttggatatattggctcattgaatcctcacacctactattttacagagatgccagtggggcttgagattgaatcacttgcccaggctcccactgctggtaaacagtagagggggctcctgacccatcagtctggcttgacaacccattccctcaactgcggatcccggattcccttatcaccctgttgatttctccatagctgtggtaacatttgttgcatgaatggaccgttgaaatagggcctggcagggagaaattcaggaaatgaatgaatggttcttccctggcagccttgatgacttacaagccctcaaggggaagcattttctcctggactccttgatgccggagctgctggtgtttcccgcccagacagatctgcatgaacacccactgtaccgggccggacacctcattctgcaggacagggccagctgtctcccagccatgctgctggacccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcctgggttggcgtctcctgctgtgagctggctgaggaggacttcctggcggtctcccccttagatccgcgctatcgtgaggtccactatgtcctgctggatccttcctgcagtggctcgggtgagatggtgagaaggcgtggctgagggactcggaggtccacagcagcttagacctggagtcatctgttttggtcttagttctgacactttaatgggcttgggaccctggagcaaaagttctcctctgtgaggcaaggatttcaggagcgaggatttcaggactgaggcagcctgtgaagctgtgtaaccgagacacgcttttccttaggtatgccgagcagacagctggaggatcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtaccagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacctcagcctcacaggccaaagcatcagcaccagaacgcacacccagcccagccccaaagagaaagaagagacagcaaagagccgcagccggtgcttgcacaccgccttgcacatagcagaggctccaggctgactccttcctggtgggaaaggaagatgcctgtcctctccgtggaggaccctgggccctcaccgcaggcagcagtttgcattttgaaaggttattgggtcccttcctcgggctgtgttcttgctggtgagcaaaagtgttgcctgcagaaataaaatgcagaacgtactcta

SEQ ID NO: 355470 - DNA, 1279 bp, Homo sapiens
agccgtaaaggcgcgcgggaacatggggctgtacgctgcggtggcaggcgtgctggccggcgtggagagccgccaggctctatcaaggggctggtgtactccagcaacttccagccttgatgacttacaagccctcaaggggaagcattttctcctggactccttgatgccggagctgctggtgtttcccgcccagacagatctgcatgaacacccactgtaccgggccggacacctcattctgcaggacagggccagctgtctcccagccatgctgctggacccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcctgggttggcgtctcctgctgtgagctggctgaggaggacttcctggcggtctcccccttagatccgcgctatcgtgaggtccactatgtcctgctggatccttcctgcagtggctcgggtgagatggtatgccgagcagacagctggaggatcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtaccagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgagtgagtgggggcatgcttgggaggcgcaggatggtactggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccaggctgactccttcctggtgggaaaggaagatgcctgtcctctccgtggaggaccctgggccctcaccgcaggcagcagtttgcattttgaaaggttattgggtcccttcctcgggctgtgttcttgctggtgagcaaaagtgttgcctgcagaaataaaatgcagaacgtactcta

SEQ ID NO: 355471 - DNA, 1328 bp, Homo sapiens
agccgtaaaggcgcgcgggaacatggggctgtacgctgcggtggcaggcgtgctggccggcgtggagagccgccaggctctatcaaggggctggtgtactccagcaacttccagaacgtgaagcagctgtacgcgctggtgtgcgaaacgcagcgctactccgccgtgctggatgccgtgatctccagcgccggcctcctcagtgcgaagaagctgcagccgcacctggccaaggccttgatgacttacaagccctcaaggggaagcattttctcctggactccttgatgccggagctgctggtgtttcccgcccagacagatctgcatgaacacccactgtaccgggccggacacctcattctgcaggacagggccagctgtctcccagccatgctgctggacccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcctgggttggcgtctcctgctgtgagctggctgaggaggacttcctggcggtctcccccttagatccgcgctatcgtgaggtccactatgtcctgctggatccttcctgcagtggctcgggtgagatggtatgccgagcagacagctggaggatcccggggcagggacacctagcccgcggctcgtctactccatgtgctccctctgccaggaggagaatgaagacatggtaccagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgagtgagtgggggcatgcttgggaggcgcaggatggtactggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccaggctgactccttcctggtgggaaaggaagatgcctgtcctctccgtggaggaccctgggccctcaccgcaggcagcagtttgcattttgaaaggttattgggtcccttcctcgggctgtgttcttgctggtgagcaaaagtgttgcctgcagaaataaaatgcagaacgtactcta

SEQ ID NO: 355472 - DNA, 1624 bp, Homo sapiens
agccgtaaaggcgcgcgggaacatggggctgtacgctgcggtggcaggcgtgctggccggcgtggagagccgccaggctctatcaaggggctggtgtactccagcaacttccagaacgtgaagcagctgtacgcgctggtgtgcgaaacgcagcgctactccgccgtgctggatgccgtgatctccagcgccggcctcctcagtgcgaagaagctgcagccgcacctggccaagggtaggggcggggcggggaagtgaaccccgacggtcagcgctttgtcatctggtttcagccccgctgccgtgcacggcgggactggagcaagtcgctcacctgaaatgagtatgagcagaccttccctgggttacgaattgagatgggatgaaaatgctttaacttcgagtgttttgaaggattaaataaccgaagtacaaagtagtagtagcggagacagtaaggaagtcgggcgtggcggcgcgcacctgtggtcccagctactcggaaggctgaggggggaggatcacttgagcccaggagttcgaagctgcagtgagctgttatgtggccactgcacttcagcctgggcgacagatctagaccccattctaaaaaaaaacaaaaaccccaaacccacgaaagggtaatgttggcaagaagttgggtgcagaggtctactggtgaacatctgtggggaaagggtctaaggctgggaagcgagacgccaggttccgatcctgttgtgtagttaatttctggtgtggtcttgagtaaggtaccccacctttatctgtaaccatctagtcaggtgatctctttagccattccagtgcccgggctctattagagttagttctaaggcattcatacttcttgcttagggcgtttctgtctttgatccctcatccccaggtgctagtgtatgagttgttgggaaagggctttcgagggggtgggggccaatggaaggctctgttgggacggcaccaggcgaggtgttgagttggctcggctcaaggttcttcggggtgtgagctggcatgaggacctgttggaagtgggatccaggcctggtccaggtgagctggaaggagttgaggggcgggggaggtggggaactttgctcctgcctactcactgctcattgcgtcctacctacctcccagctgcctcgatttgtgcgtgtgaacactctcaagacctgctccgtttatgtagttatttcaagagacaaggtttctcctatcagggtcgggcttccaggctggatggagtgccctggcgcgatctcggctcaccgcaacctctgcctcctgggttcaagcgattctcctgcttcagccttctgagcagctgggattatgaaggggtggcctgcccctccacatctgtgggatatctcatcaggtgggacaagagactgagaaaagaaataagacacagagacaaagtatagagaaacaacagtgggcccaggagactggcacttagcataccaaggacctgcaccagcactggtctccgagttccctcagtttttattgattattattttcattatctcagcacaaggaatgcggtaggagagcagggtgataataaggagaaggtcagcaaaaaaacctg

SEQ ID NO: 355473 - DNA, 603 bp, Homo sapiens
ctgcctactcactgctcattgcgtcctacctacctcccagctgcctcgatttgtgcgtgtgaacactctcaagacctgctccgtttatgtagttatttcaagagacaaggtttctcctatcagggtcgggcttccaggtgagagcttagagccctggctgtcctcatctagggaggtgtctggggtactgggaagagaagtggttggatagttgtgactttgctctctgggctttgttcctacctttccagcagtttctccatctccaaggtttgttttcctcgcatcccttaaacatcgaactcctaggagccccatcctacattcttccggagctctccgttttttctctaactttagctcctgcctcccacctggtgattctcaccgcccagtgtagacttcccttttgcattcttccctccttaggttcacatgaatgcaccacagatgccacagtcgctgcattcatctttcctctcagactttacacttagtacatccccagtttaatctaacagatgtcaccgttttccacccatttggtcaagccagaaaccgagtcatcctaggtgcttccttcccctccctccaatcatttac

SEQ ID NO: 355474 - DNA, 830 bp, Homo sapiens
atcacttgcccaggctcccactgctggtaaacagtagagggggctcctgacccatcagtctggcttgacaacccattccctcaactgcggatcccggattcccttatcaccctgttgatttctccatagctgtggtaacatttgttgcatgaatggaccgttgaaatagggcctggcagggagaaattcaggaaatgaatgaatggttcttccctggcagccttgatgacttacaagccctcaaggggaagcattttctcctggactccttgatgccggagctgctggtgtttcccgcccagacagatctgcatgaacacccactgtaccgggccggacacctcattctgcaggacagggtaggcaagaggaatagaaaagggaagaatgtgtaggcacgggaagggcctagcctggggtctctgtttacccggcccctgtgctctgcctgccaggccagctgtctcccagccatgctgctggacccccgccaggctcccatgtcatcgatgcctgtgccgccccaggcaataagaccagtcacttggctgctcttctgaagaaccaagggtgagtgccacaggaggaggaggaggaggacatggggtttgattttgtgcctttcagtgggtaataaaggctgaaaggatgactttcgcttaactctttcctgctgtaccaaagtagttcacggtatttgccccaagctaagctttccccactgcaggtgtgagatgtggatcccttagcccttggggcagagaccccaggccagttacctctgaccctgggccctttaaatataggccgtttcaatattgtgtgtcctg

SEQ ID NO: 355475 - DNA, 424 bp, Homo sapiens
gaagtggttggatagttgtgactttgctctctgggctttgttcctacctttccagcagtttctccatctccaaggtttgttttcctcgcatcccttaaacatcgaactcctaggagccccatcctacattcttccggagctctccgttttttctctaactttagctcctgcctcccacctggtgattctcaccgcccagtgtagacttcccttttgcattcttccctccttaggttcacatgaatgcaccacagatgccacagtcgctgcattcatctttcctctcagactttacacttagtacatccccagtttaatctaacagatgtcaccgttttccacccatttggtcaagccacggtcaacccacaagccacggtcaacccacaagccacggtcaacccacaagccacggtcaacccac

SEQ ID NO: 355476 - DNA, 2980 bp, Homo sapiens
gctggacgcaaaggccgaccatacacccacgaaagggtaatgttggcaagaagttgggtgcagaggtctactggtgaacatctgtggggaaagggtctaaggctgggaagcgagacgccaggttccgatcctgttgtgtagttaatttctggtgtggtcttgagtaaggtaccccacctttatctgtaaccatctagtcaggtgatctctttagccattccagtgcccgggctctattagagttagttctaaggcattcatacttcttgcttagggcgtttctgtctttgatccctcatccccaggtgctagtgtatgagttgttgggaaagggctttcgagggggtgggggccaatggaaggctctgttgggacggcaccaggcgaggtgttgagttggctcggctcaaggttcttcggggtgtgagctggcatgaggacctgttggaagtgggatccaggcctggtccaggtgagctggaaggagttgaggggcgggggaggtggggaactttgctcctgcctactcactgctcattgcgtcctacctacctcccagctgcctcgatttgtgcgtgtgaacactctcaagacctgctccgtttatgtagttatttcaagagacaaggtttctcctatcagggtcgggcttccaggctggatggagtgccctggcgcgatctcggctcaccgcaacctctgcctcctgggttcaagcgattctcctgcttcagccttctgagcagctgggattatgaaggggtggcctgcccctccacatctgtgggatatctcatcaggtgggacaagagactgagaaaagaaataagacacagagacaaagtatagagaaacaacaagtggctggtctctgccccgtgcctcctccactgggctcacacctgtcttattttgtcctttggtggctctgagaagcagcctctgcccctctccctttcccttactctttgtaagatcctcttccttctgccctaccatgttgcttggacaccagggtggaatagcagagaacggctgcttgtgtttgaattccagctctgccacttcgatagatttctgaactgagacatgtgactctctaggcctatttctgcatgggtcggagagtgggcgggactgctttactgagttatagtgaatgtagttttaacctaagcgcctcacatgactaactcctcatccatcaagaatgagctcagctctcacttccccactcctcacccccctgtaaagtaacctttctccaaggttatgcttcaacaggaatagctaacatttattaaattgtggcacgtaagtatcttggatatattggctcattgaatcctcacacctactattttacagagatgccagtggggcttgagattgaatcacttgcccaggctcccactgctggtaaacagtagagggggctcctgacccatcagtctggcttgacaacccattccctcaactgcggatcccggattcccttatcaccctgttgatttctccatagctgtggtaacatttgttgcatgaatggaccgttgaaatagggcctggcagggagaaattcaggaaatgaatgaatggttcttccctggcagccttgatgacttacaagccctcaaggggaagcattttctcctggactccttgatgccggagctgctggtgtttcccgcccagacagatctgcatgaacacccactgtaccgggccggacacctcattctgcaggacagggccagctgtctcccagccatgctgctggacccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcctgggttggcgtctcctgctgtgagctggctgaggaggacttcctggcggtctcccccttagatccgcgctatcgtgaggtccactatgtcctgctggatccttcctgcagtggctcgggtgagatggtgagaaggcgtggctgagggactcggaggtccacagcagcttagacctggagtcatctgttttggtcttagttctgacactttaatgggcttgggaccctggagcaaaagttctcctctgtgaggcaaggatttcaggagcgaggatttcaggactgaggcagcctgtgaagctgtgtaaccgagacacgcttttccttaggtatgccgagcagacagctggaggatcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtaccagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgagtgagtgggggcatgcttgggaggcgcaggatggtactggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccaggctgactccttcctggtgggaaaggaagatgcctgtcctctccgtggaggaccctgggccctcaccgcaggcagcagtttgcattttgaaaggttattgggtcccttcctcgggctgtgttcttgctggtgagcaaaagtgttgcctgcagaaataaaatgcagaacgtactcta

SEQ ID NO: 355477 - DNA, 3383 bp, Homo sapiens
agccgtaaaggcgcgcgggaacatggggctgtacgctgcggtggcaggcgtgctggccggcgtggagagccgccaggctctatcaaggggctggtgtactccagcaacttccagaacgtgaagcagctgtacgcgctggtgtgcgaaacgcagcgctactccgccgtgctggatgccgtgatctccagcgccggcctcctcagtgcgaagaagctgcagccgcacctggccaagggtaggggcggggcggggaagtgaaccccgacggtcagcgctttgtcatctggtttcagccccgctgccgtgcacggcgggactggagcaagtcgctcacctgaaatgagtatgagcagaccttccctgggttacgaattgagatgggatgaaaatgctttaacttcgagtgttttgaaggattaaataaccgaagtacaaagtagtagtagcggagacagtaaggaagtcgggcgtggcggcgcgcacctgtggtcccagctactcggaaggctgaggggggaggatcacttgagcccaggagttcgaagctgcagtgagctgttatgtggccactgcacttcagcctgggcgacagatctagaccccattctaaaaaaaaacaaaaaccccaaacccacgaaagggtaatgttggcaagaagttgggtgcagaggtctactggtgaacatctgtggggaaagggtctaaggctgggaagcgagacgccaggttccgatcctgttgtgtagttaatttctggtgtggtcttgagtaaggtaccccacctttatctgtaaccatctagtcaggtgatctctttagccattccagtgcccgggctctattagagttagttctaaggcattcatacttcttgcttagggcgtttctgtctttgatccctcatccccaggtgctagtgtatgagttgttgggaaagggctttcgagggggtgggggccaatggaaggctctgttgggacggcaccaggcgaggtgttgagttggctcggctcaaggttcttcggggtgtgagctggcatgaggacctgttggaagtgggatccaggcctggtccaggtgagctggaaggagttgaggggcgggggaggtggggaactttgctcctgcctactcactgctcattgcgtcctacctacctcccagctgcctcgatttgtgcgtgtgaacactctcaagacctgctccgtttatgtagttatttcaagagacaaggtttctcctatcagggtcgggcttccaggctggatggagtgccctggcgcgatctcggctcaccgcaacctctgcctcctgggttcaagcgattctcctgcttcagccttctgagcagctgggattatgaaggggtggcctgcccctccacatctgtgggatatctcatcaggtgggacaagagactgagaaaagaaataagacacagagacaaagtatagagaaacaacaagtggctggtctctgccccgtgcctcctccactgggctcacacctgtcttattttgtcctttggtggctctgagaagcagcctctgcccctctccctttcccttactctttgtaagatcctcttccttctgccctaccatgttgcttggacaccagggtggaatagcagagaacggctgcttgtgtttgaattccagctctgccacttcgatagatttctgaactgagacatgtgactctctaggcctatttctgcatgggtcggagagtgggcgggactgctttactgagttatagtgaatgtagttttaacctaagcgcctcacatgactaactcctcatccatcaagaatgagctcagctctcacttccccactcctcacccccctgtaaagtaacctttctccaaggttatgcttcaacaggaatagctaacatttattaaattgtggcacgtaagtatcttggatatattggctcattgaatcctcacacctactattttacagagatgccagtggggcttgagattgaatcacttgcccaggctcccactgctggtaaacagtagagggggctcctgacccatcagtctggcttgacaacccattccctcaactgcggatcccggattcccttatcaccctgttgatttctccatagctgtggtaacatttgttgcatgaatggaccgttgaaatagggcctggcagggagaaattcaggaaatgaatgaatggttcttccctggcagccttgatgacttacaagccctcaaggggaagcattttctcctggactccttgatgccggagctgctggtgtttcccgcccagacagatctgcatgaacacccactgtaccgggccggacacctcattctgcaggacagggccagctgtctcccagccatgctgctggacccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcctgggttggcgtctcctgctgtgagctggctgaggaggacttcctggcggtctcccccttagatccgcgctatcgtgaggtccactatgtcctgctggatccttcctgcagtggctcgggtgagatggtatgccgagcagacagctggaggatcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtaccagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgagtgagtgggggcatgcttgggaggcgcaggatggtactggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccaggctgactccttcctggtgggaaaggaagatgcctgtcctctccgtggaggaccctgggccctcaccgcaggcagcagtttgcattttgaaaggttattgggtcccttcctcgggctgtgttcttgctggtgagcaaaagtgttgcctgcagaaataaaatgcagaacgtactcta

SEQ ID NO: 355478 - DNA, 2570 bp, Homo sapiens
agccgtaaaggcgcgcgggaacatggggctgtacgctgcggtggcaggcgtgctggccggcgtggagagccgccaggctctatcaaggggctggtgtactccagcaacttccagaacgtgaagcagctgtacgcgctggtgtgcgaaacgcagcgctactccgccgtgctggatgccgtgatctccagcgccggcctcctcagtgcgaagaagctgcagccgcacctggccaagggtaggggcggggcggggaagtgaaccccgacggtcagcgctttgtcatctggtttcagccccgctgccgtgcacggcgggactggagcaagtcgctcacctgaaatgagtatgagcagaccttccctgggttacgaattgagatgggatgaaaatgctttaacttcgagtgttttgaaggattaaataaccgaagtacaaagtagtagtagcggagacagtaaggaagtcgggcgtggcggcgcgcacctgtggtcccagctactcggaaggctgaggggggaggatcacttgagcccaggagttcgaagctgcagtgagctgttatgtggccactgcacttcagcctgggcgacagatctagaccccattctaaaaaaaaacaaaaaccccaaacccacgaaagggtaatgttggcaagaagttgggtgcagaggtctactggtgaacatctgtggggaaagggtctaaggctgggaagcgagacgccaggttccgatcctgttgtgtagttaatttctggtgtggtcttgagtaaggtaccccacctttatctgtaaccatctagtcaggtgatctctttagccattccagtgcccgggctctattagagttagttctaaggcattcatacttcttgcttagggcgtttctgtctttgatccctcatccccaggtgctagtgtatgagttgttgggaaagggctttcgagggggtgggggccaatggaaggctctgttgggacggcaccaggcgaggtgttgagttggctcggctcaaggttcttcggggtgtgagctggcatgaggacctgttggaagtgggatccaggcctggtccaggtgagctggaaggagttgaggggcgggggaggtggggaactttgctcctgcctactcactgctcattgcgtcctacctacctcccagctgcctcgatttgtgcgtgtgaacactctcaagacctgctccgtttatgtagttatttcaagagacaaggtttctcctatcagggtcgggcttccaggctggatggagtgccctggcgcgatctcggctcaccgcaacctctgcctcctgggttcaagcgattctcctgcttcagccttctgagcagctgggattatgaaggggtggcctgcccctccacatctgtgggatatctcatcagccttgatgacttacaagccctcaaggggaagcattttctcctggactccttgatgccggagctgctggtgtttcccgcccagacagatctgcatgaacacccactgtaccgggccggacacctcattctgcaggacagggccagctgtctcccagccatgctgctggacccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcctgggttggcgtctcctgctgtgagctggctgaggaggacttcctggcggtctcccccttagatccgcgctatcgtgaggtccactatgtcctgctggatccttcctgcagtggctcgggtgagatggtatgccgagcagacagctggaggatcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtaccagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgagtgagtgggggcatgcttgggaggcgcaggatggtactggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccaggctgactccttcctggtgggaaaggaagatgcctgtcctctccgtggaggaccctgggccctcaccgcaggcagcagtttgcattttgaaaggttattgggtcccttcctcgggctgtgttcttgctggtgagcaaaagtgttgcctgcagaaataaaatgcagaacgtactcta

SEQ ID NO: 355479 - DNA, 2831 bp, Homo sapiens
agccgtaaaggcgcgcgggaacatggggctgtacgctgcggtggcaggcgtgctggccggcgtggagagccgccaggctctatcaaggggctggtgtactccagcaacttccagaacgtgaagcagctgtacgcgctggtgtgcgaaacgcagcgctactccgccgtgctggatgccgtgatctccagcgccggcctcctcagtgcgaagaagctgcagccgcacctggccaagggtgctagtgtatgagttgttgggaaagggctttcgagggggtgggggccaatggaaggctctgttgggacggcaccaggcgaggtgttgagttggctcggctcaaggttcttcggggtgtgagctggcatgaggacctgttggaagtgggatccaggcctggtccagcctcccagctgcctcgatttgtgcgtgtgaacactctcaagacctgctccgtttatgtagttatttcaagagacaaggtttctcctatcagggtcgggcttccaggctggatggagtgccctggcgcgatctcggctcaccgcaacctctgcctcctgggttcaagcgattctcctgcttcagccttctgagcagctgggattatgaaggggtggcctgcccctccacatctgtgggatatctcatcaggtgggacaagagactgagaaaagaaataagacacagagacaaagtatagagaaacaacaagtggctggtctctgccccgtgcctcctccactgggctcacacctgtcttattttgtcctttggtggctctgagaagcagcctctgcccctctccctttcccttactctttgtaagatcctcttccttctgccctaccatgttgcttggacaccagggtggaatagcagagaacggctgcttgtgtttgaattccagctctgccacttcgatagatttctgaactgagacatgtgactctctaggcctatttctgcatgggtcggagagtgggcgggactgctttactgagttatagtgaatgtagttttaacctaagcgcctcacatgactaactcctcatccatcaagaatgagctcagctctcacttccccactcctcacccccctgtaaagtaacctttctccaaggttatgcttcaacaggaatagctaacatttattaaattgtggcacgtaagtatcttggatatattggctcattgaatcctcacacctactattttacagagatgccagtggggcttgagattgaatcacttgcccaggctcccactgctggtaaacagtagagggggctcctgacccatcagtctggcttgacaacccattccctcaactgcggatcccggattcccttatcaccctgttgatttctccatagctgtggtaacatttgttgcatgaatggaccgttgaaatagggcctggcagggagaaattcaggaaatgaatgaatggttcttccctggcagccttgatgacttacaagccctcaaggggaagcattttctcctggactccttgatgccggagctgctggtgtttcccgcccagacagatctgcatgaacacccactgtaccgggccggacacctcattctgcaggacagggccagctgtctcccagccatgctgctggacccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcctgggttggcgtctcctgctgtgagctggctgaggaggacttcctggcggtctcccccttagatccgcgctatcgtgaggtccactatgtcctgctggatccttcctgcagtggctcgggtgagatggtgagaaggcgtggctgagggactcggaggtccacagcagcttagacctggagtcatctgttttggtcttagttctgacactttaatgggcttgggaccctggagcaaaagttctcctctgtgaggcaaggatttcaggagcgaggatttcaggactgaggcagcctgtgaagctgtgtaaccgagacacgcttttccttaggtatgccgagcagacagctggaggatcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtaccagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgagtgagtgggggcatgcttgggaggcgcaggatggtactggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccaggctgactccttcctggtgggaaaggaagatgcctgtcctctccgtggaggaccctgggccctcaccgcaggcagcagtttgcattttgaaaggttattgggtcccttcctcgggctgtgttcttgctggtgagcaaaagtgttgcctgcagaaataaaatgcagaacgtactcta

SEQ ID NO: 355480 - DNA, 2018 bp, Homo sapiens
agccgtaaaggcgcgcgggaacatggggctgtacgctgcggtggcaggcgtgctggccggcgtggagagccgccaggctctatcaaggggctggtgtactccagcaacttccagaacgtgaagcagctgtacgcgctggtgtgcgaaacgcagcgctactccgccgtgctggatgccgtgatctccagcgccggcctcctcagtgcgaagaagctgcagccgcacctggccaagggtgctagtgtatgagttgttgggaaagggctttcgagggggtgggggccaatggaaggctctgttgggacggcaccaggcgaggtgttgagttggctcggctcaaggttcttcggggtgtgagctggcatgaggacctgttggaagtgggatccaggcctggtccagcctcccagctgcctcgatttgtgcgtgtgaacactctcaagacctgctccgtttatgtagttatttcaagagacaaggtttctcctatcagggtcgggcttccaggctggatggagtgccctggcgcgatctcggctcaccgcaacctctgcctcctgggttcaagcgattctcctgcttcagccttctgagcagctgggattatgaaggggtggcctgcccctccacatctgtgggatatctcatcagccttgatgacttacaagccctcaaggggaagcattttctcctggactccttgatgccggagctgctggtgtttcccgcccagacagatctgcatgaacacccactgtaccgggccggacacctcattctgcaggacagggccagctgtctcccagccatgctgctggacccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcctgggttggcgtctcctgctgtgagctggctgaggaggacttcctggcggtctcccccttagatccgcgctatcgtgaggtccactatgtcctgctggatccttcctgcagtggctcgggtgagatggtgagaaggcgtggctgagggactcggaggtccacagcagcttagacctggagtcatctgttttggtcttagttctgacactttaatgggcttgggaccctggagcaaaagttctcctctgtgaggcaaggatttcaggagcgaggatttcaggactgaggcagcctgtgaagctgtgtaaccgagacacgcttttccttaggtatgccgagcagacagctggaggatcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtaccagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgagtgagtgggggcatgcttgggaggcgcaggatggtactggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccaggctgactccttcctggtgggaaaggaagatgcctgtcctctccgtggaggaccctgggccctcaccgcaggcagcagtttgcattttgaaaggttattgggtcccttcctcgggctgtgttcttgctggtgagcaaaagtgttgcctgcagaaataaaatgcagaacgtactcta

SEQ ID NO: 355481 - DNA, 2177 bp, Homo sapiens
agccgtaaaggcgcgcgggaacatggggctgtacgctgcggtggcaggcgtgctggccggcgtggagagccgccaggctctatcaaggggctggtgtactccagcaacttccagaacgtgaagcagctgtacgcgctggtgtgcgaaacgcagcgctactccgccgtgctggatgccgtgatctccagcgccggcctcctcagtgcgaagaagctgcagccgcacctggccaagggtgctagtgtatgagttgttgggaaagggctttcgagggggtgggggccaatggaaggctctgttgggacggcaccaggcgaggtgttgagttggctcggctcaaggttcttcggggtgtgagctggcatgaggacctgttggaagtgggatccaggcctggtccagcctcccagctgcctcgatttgtgcgtgtgaacactctcaagacctgctccgtttatgtagttatttcaagagacaaggtttctcctatcagggtcgggcttccaggctggatggagtgccctggcgcgatctcggctcaccgcaacctctgcctcctgggttcaagcgattctcctgcttcagccttctgagcagctgggattatgaaggggtggcctgcccctccacatctgtgggatatctcatcagagatgccagtggggcttgagattgaatcacttgcccaggctcccactgctggtaaacagtagagggggctcctgacccatcagtctggcttgacaacccattccctcaactgcggatcccggattcccttatcaccctgttgatttctccatagctgtgccttgatgacttacaagccctcaaggggaagcattttctcctggactccttgatgccggagctgctggtgtttcccgcccagacagatctgcatgaacacccactgtaccgggccggacacctcattctgcaggacagggccagctgtctcccagccatgctgctggacccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcctgggttggcgtctcctgctgtgagctggctgaggaggacttcctggcggtctcccccttagatccgcgctatcgtgaggtccactatgtcctgctggatccttcctgcagtggctcgggtgagatggtgagaaggcgtggctgagggactcggaggtccacagcagcttagacctggagtcatctgttttggtcttagttctgacactttaatgggcttgggaccctggagcaaaagttctcctctgtgaggcaaggatttcaggagcgaggatttcaggactgaggcagcctgtgaagctgtgtaaccgagacacgcttttccttaggtatgccgagcagacagctggaggatcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtaccagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgagtgagtgggggcatgcttgggaggcgcaggatggtactggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccaggctgactccttcctggtgggaaaggaagatgcctgtcctctccgtggaggaccctgggccctcaccgcaggcagcagtttgcattttgaaaggttattgggtcccttcctcgggctgtgttcttgctggtgagcaaaagtgttgcctgcagaaataaaatgcagaacgtactcta

SEQ ID NO: 355482 - DNA, 1400 bp, Homo sapiens
agccgtaaaggcgcgcgggaacatggggctgtacgctgcggtggcaggcgtgctggccggcgtggagagccgccaggctctatcaaggggctggtgtactccagcaacttccagaacgtgaagcagctgtacgcgctggtgtgcgaaacgcagcgctactccgccgtgctggatgccgtgatctccagcgccggcctcctcagtgcgaagaagctgcagccgcacctggccaaggccttgatgacttacaagccctcaaggggaagcattttctcctggactccttgatgccggagctgctggtgtttcccgcccagacagatctgcatgaacacccactgtaccgggccggacacctcattctgcaggacagggccagctgtctcccagccatgctgctggacccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcctgggttggcgtctcctgctgtgagctggctgaggaggacttcctggcggtctcccccttagatccgcgctatcgtgaggtccactatgtcctgctggatccttcctgcagtggctcgggtgagatggtatgccgagcagacagctggaggatcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtaccagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgagtgagtgggggcatgcttgggaggcgcaggatggtactggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccaggctgactccttcctggtgggaaaggaagatgcctgtcctctccgtggaggaccctgggccctcaccgcaggcagcagtttgcattttgaaaggttattgggtcccttcctcgggctgtgttcttgctggtgagcaaaagtgttgcctgcagaaataaaatgcagaacgtactcta

SEQ ID NO: 355483 - DNA, 1544 bp, Homo sapiens
agccgtaaaggcgcgcgggaacatggggctgtacgctgcggtggcaggcgtgctggccggcgtggagagccgccaggctctatcaaggggctggtgtactccagcaacttccagaacgtgaagcagctgtacgcgctggtgtgcgaaacgcagcgctactccgccgtgctggatgccgtgatctccagcgccggcctcctcagtgcgaagaagctgcagccgcacctggccaagggctggatggagtgccctggcgcgatctcggctcaccgcaacctctgcctcctgggttcaagcgattctcctgcttcagccttctgagcagctgggattatgaaggggtggcctgcccctccacatctgtgggatatctcatcagccttgatgacttacaagccctcaaggggaagcattttctcctggactccttgatgccggagctgctggtgtttcccgcccagacagatctgcatgaacacccactgtaccgggccggacacctcattctgcaggacagggccagctgtctcccagccatgctgctggacccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcctgggttggcgtctcctgctgtgagctggctgaggaggacttcctggcggtctcccccttagatccgcgctatcgtgaggtccactatgtcctgctggatccttcctgcagtggctcgggtgagatggtatgccgagcagacagctggaggatcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtaccagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgagtgagtgggggcatgcttgggaggcgcaggatggtactggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccaggctgactccttcctggtgggaaaggaagatgcctgtcctctccgtggaggaccctgggccctcaccgcaggcagcagtttgcattttgaaaggttattgggtcccttcctcgggctgtgttcttgctggtgagcaaaagtgttgcctgcagaaataaaatgcagaacgtactcta

SEQ ID NO: 355484 - DNA, 4031 bp, Homo sapiens
agccgtaaaggcgcgcgggaacatggggctgtacgctgcggtggcaggcgtgctggccggcgtggagagccgccaggctctatcaaggggctggtgtactccagcaacttccagaacgtgaagcagctgtacgcgctggtgtgcgaaacgcagcgctactccgccgtgctggatgccgtgatctccagcgccggcctcctcagtgcgaagaagctgcagccgcacctggccaagggtaggggcggggcggggaagtgaaccccgacggtcagcgctttgtcatctggtttcagccccgctgccgtgcacggcgggactggagcaagtcgctcacctgaaatgagtatgagcagaccttccctgggttacgaattgagatgggatgaaaatgctttaacttcgagtgttttgaaggattaaataaccgaagtacaaagtagtagtagcggagacagtaaggaagtcgggcgtggcggcgcgcacctgtggtcccagctactcggaaggctgaggggggaggatcacttgagcccaggagttcgaagctgcagtgagctgttatgtggccactgcacttcagcctgggcgacagatctagaccccattctaaaaaaaaacaaaaaccccaaacccacgaaagggtaatgttggcaagaagttgggtgcagaggtctactggtgaacatctgtggggaaagggtctaaggctgggaagcgagacgccaggttccgatcctgttgtgtagttaatttctggtgtggtcttgagtaaggtaccccacctttatctgtaaccatctagtcaggtgatctctttagccattccagtgcccgggctctattagagttagttctaaggcattcatacttcttgcttagggcgtttctgtctttgatccctcatccccaggtgctagtgtatgagttgttgggaaagggctttcgagggggtgggggccaatggaaggctctgttgggacggcaccaggcgaggtgttgagttggctcggctcaaggttcttcggggtgtgagctggcatgaggacctgttggaagtgggatccaggcctggtccaggtgagctggaaggagttgaggggcgggggaggtggggaactttgctcctgcctactcactgctcattgcgtcctacctacctcccagctgcctcgatttgtgcgtgtgaacactctcaagacctgctccgtttatgtagttatttcaagagacaaggtttctcctatcagggtcgggcttccaggctggatggagtgccctggcgcgatctcggctcaccgcaacctctgcctcctgggttcaagcgattctcctgcttcagccttctgagcagctgggattatgaaggggtggcctgcccctccacatctgtgggatatctcatcaggtgggacaagagactgagaaaagaaataagacacagagacaaagtatagagaaacaacaagtggctggtctctgccccgtgcctcctccactgggctcacacctgtcttattttgtcctttggtggctctgagaagcagcctctgcccctctccctttcccttactctttgtaagatcctcttccttctgccctaccatgttgcttggacaccagggtggaatagcagagaacggctgcttgtgtttgaattccagctctgccacttcgatagatttctgaactgagacatgtgactctctaggcctatttctgcatgggtcggagagtgggcgggactgctttactgagttatagtgaatgtagttttaacctaagcgcctcacatgactaactcctcatccatcaagaatgagctcagctctcacttccccactcctcacccccctgtaaagtaacctttctccaaggttatgcttcaacaggaatagctaacatttattaaattgtggcacgtaagtatcttggatatattggctcattgaatcctcacacctactattttacagagatgccagtggggcttgagattgaatcacttgcccaggctcccactgctggtaaacagtagagggggctcctgacccatcagtctggcttgacaacccattccctcaactgcggatcccggattcccttatcaccctgttgatttctccatagctgtggtaacatttgttgcatgaatggaccgttgaaatagggcctggcagggagaaattcaggaaatgaatgaatggttcttccctggcagccttgatgacttacaagccctcaaggggaagcattttctcctggactccttgatgccggagctgctggtgtttcccgcccagacagatctgcatgaacacccactgtaccgggccggacacctcattctgcaggacagggccagctgtctcccagccatgctgctggacccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcctgggttggcgtctcctgctgtgagctggctgaggaggacttcctggcggtctcccccttagatccgcgctatcgtgaggtccactatgtcctgctggatccttcctgcagtggctcgggtgagatggtgagaaggcgtggctgagggactcggaggtccacagcagcttagacctggagtcatctgttttggtcttagttctgacactttaatgggcttgggaccctggagcaaaagttctcctctgtgaggcaaggatttcaggagcgaggatttcaggactgaggcagcctgtgaagctgtgtaaccgagacacgcttttccttaggtatgccgagcagacagctggaggatcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtaccagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacctcagcctcacaggccaaagcatcagcaccagaacgcacacccagcccagccccaaagagaaagaagagacagcaaagagccgcagccggtgcttgcacaccgccttgcacatagcagaggctccaggctgactccttcctggtgggaaaggaagatgcctgtcctctccgtggaggaccctgggccctcaccgcaggcagcagtttgcattttgaaaggttattgggtcccttcctcgggctgtgttcttgctggtgagcaaaagtgttgcctgcagaaataaaatgcagaacgtactctaaaaaaaaaaaaaaaaacaacaaagaaaaaaaaaaaggggcgcggcgccgaccaagaaagtacaccccacagagggcgcccaaggacacagacgggtacccacaggttccttggacacacaagggggccccaaaaaggggacgccggaaatcaataacgcctagggccaccgtgtgaccgcagcgtttgtaccaaagcgttgcgcggagaccgtgtggcaaaacatcggcaaagactgtggagacaccctgggtaaagagggaccttattaaatactcgctcagtggtgatcggaccctaactgcgagcaccaaagctcaacccaccacagagagaaatataaaaagagccctccaaagggggaacaacatttacacaagttgtgaagcagcggggtaaaacagcagcggcttcaaacaagcatagacaggcaccaaacggcaaacacgacgcactgacaaaaaacgactatccggcgacccggaaacctacaaggcgcgagcacaaacattgcacg

SEQ ID NO: 355485 - DNA, 2163 bp, Homo sapiens
agctcgttcgccgcactttggaggcttcggctgcccctccgacccacgtagggcccggacccgggcctccttgtgaacagcgtgccggcttcgccccacgggttcaccggctggctgggcttcaagcgccgaggccgccgcagtgaccccgcccccgggccgaggatgtgaggcgggccgggcgtccccacaccgggcccgggcgccgggagtgggcgtctgggcagcgccaggcgatggccctgctgctggtgctcctcgcctcttggggcctggggcagtgagggggccggcgggcgtgggccgagtggccgcgggcgccatggagggggtgctgtacaagtggaccaactatctgagcggttggcagcctcgatggttccttctctgtgggggaatattgtcctattatgattctcctgaagatgcctggaaaggttgcaaagggagcatacaaatggcagtctgtgaaattcaagttcattctgtagataatacacgcatggacctgataatccctggggaacagtatttctacctgaaggccagaagtgtggctgaaagacagcggtggctggtggccctgggatcagccaaggcttgcctgactgacagtaggacccagaaggagaaagagtttgctgaaaacactgaaaacttgaaaaccaaaatgtcagaactaagactctactgtgacctccttgttcagcaagtagataaaacaaaagaagtgaccacaactggtgtgtccaattctgaggagggaattgatgtgggaactttgctgaaatcaacctgtaatacttttctgaagaccttggaagaatgcatgcagatcgcaaatgcagccttcacctctgagctgctctaccgcactccaccaggatcacctcagctggccatgctcaagtccagcaagatgaaacatcctattataccaattcataattcattggaaaggcaaatggagttgagcacttgtgaaaatggatctttaaatatggaaataaatggtgaggaagaaatcctaatgaaaaataagaattccttatatttgaaatctgcagagatagactgcagcatatcaagtgaggaaaatacagatgataatataacagtccaaggtgaaataaggaaggaagatggaatggaaaacctgaaaaatcatgacaataacttgactcagtctggatcagactcaagttgctctccggaatgcctctgggaggaaggcaaagaagttatcccaactttctttagtaccatgaacacaagctttagtgacattgaacttctggaagacagtggcattcccacagaagcattcttggcatcatgttatgctgtggttccagtattagacaaacttggccctacagtgtttgctcctgttaagatggatcttgttggaaatattaagaaagtaaatcagaagtatataaccaacaaagaagagtttaccactctccagaagatagtgctgcacgaagtggaggcggatgtagcccaggttaggaactcagcgactgaagccctcttgtggctgaagagaggtctcaaatttttgaagggatttttgacagaagtgaaaaatggggagaaggatatccagacagccctaaataatgcatatggtaaaacattgcggcaacaccatggctgggtagttcgaggggtttttgcgttagctttaagggcagctccatcctatgaagattttgtggccgcgttaaccgtaaaggaaggtgaccaccagaaagaagctttcagtattgggatgcagagggacctcagcctttacctccctgccatggagaagcagctggccatactggacactttatatgaggtccacgggctggaatctgatgaggtggtatgatggctgctgggcagcacctcctaacttcagggaataagtgctaaagtgttttgttgccctacttaatttccagcaacagcctcaaccctctccaaccccttcacctggggggatggacaggaggtggcaaaacccagtgcttttataatttttaaaatgcatatgtgttttgtttaaagatcaaggtgctatatatttcagttcagcaggcctactggaaaccaaatgataagctgctgtagacttgaacagcaagttataagagcagatttaacaaacaa

SEQ ID NO: 355486 - DNA, 1533 bp, Homo sapiens
gggaggccaaggcaggaggatcgcttgagccaaggagtttgagaccagcttgggcaacagagcaagaccccttctctacaaaaaaatctttaaaaattagccaggcgtgatggtgcatgcctgtagttccaactactcaggagagtgaggtgggaagatcgcttgagcccaggagttcaaggctgcaggccactgccctccagtccgggcaatacagcaagaccctatctctaaatatatatttcctctatctctctatctctgtagagacaaatcaagaattatattcacctaaagtggattacgattatttttaggtgtaggaatgtgggtgtagacggaactccagaaaccatcatggaccatgaggcaactctgaggatggaagccacacactaaggacggtaaagcagaaagaagagctgaaaccctgatgataaagaagcagccaattccgtcctgcactgcccacctccagatctcattcatgtgaaacaaagagaaactttatcttgttcaagtcactttagtcaagatttttattatcagatgaatgcaatttctaattgatacaccttaaaattttcaacatgtacacctgatttaacaaaatctagaattaagtcaatacttctacatgcattatagaccaaaggtcactgctataagaactttgggtatatagtcaaattcctcacatttttagaaacttgtttattcattgcatccctcccccatctcactctctcacacactcacatatttattttctcagatccttataagttcataagacatatgtccttattccatttttacagatgagaaaactggggtttgcaggggttaagtaacttatccaagatcacacaattaattagtggcgaagtcataatttgaagtctttctaatgcccaaatgtttccattgtgtcacatatcggagctgtgctctttccatcagccagtttcccattatcatagctgatgacatgcacacccaccatctggggcaggctttagtacagcactctgtgccatcatccagatcaccaaatcttagtaaatggacgtgtcataagagataaggctgccatagaatcacagcagcttctggcttagtaaattacctggatacacaccttttcctagaggaaatcccacatcttcgtaggagatctggtgtaatgctcttgggacctctctctagaggatgagctagtatcactgggtcctagtaagtttcagcaaatataatagagacagaactgtcatcattatcagaaaagaaacagagaaaaatgttaaaacaatggttttgtgaccttaaagtctgtgttagtcccttagcaccaccgctgagattttgctgaaagggacgttttgtgtgttgggcttcactgaaggaagcccctgaaagtgttcagaaatagggaaaatgagaaactgttccagctgaaaatacgggcaagggggaatcattgaagaagacagaatattgaagtgttcaaatgaataaagaagctaaaaacta

SEQ ID NO: 355487 - DNA, 1480 bp, Homo sapiens
gggaggccaaggcaggaggatcgcttgagccaaggagtttgagaccagcttgggcaacagagcaagaccccttctctacaaaaaaatctttatgaggtgggaagatcgcttgagcccaggagttcaaggctgcaggccactgccctccagtccgggcaatacagcaagaccctatctctaaatatatatttcctctatctctctatctctgtagagacaaatcaagaattatattcacctaaagtggattacgattatttttaggtgtaggaatgtgggtgtagacggaactccagaaaccatcatggaccatgaggcaactctgaggatggaagccacacactaaggacggtaaagcagaaagaagagctgaaaccctgatgataaagaagcagccaattccgtcctgcactgcccacctccagatctcattcatgtgaaacaaagagaaactttatcttgttcaagtcactttagtcaagatttttattatcagatgaatgcaatttctaattgatacaccttaaaattttcaacatgtacacctgatttaacaaaatctagaattaagtcaatacttctacatgcattatagaccaaaggtcactgctataagaactttgggtatatagtcaaattcctcacatttttagaaacttgtttattcattgcatccctcccccatctcactctctcacacactcacatatttattttctcagatccttataagttcataagacatatgtccttattccatttttacagatgagaaaactggggtttgcaggggttaagtaacttatccaagatcacacaattaattagtggcgaagtcataatttgaagtctttctaatgcccaaatgtttccattgtgtcacatatcggagctgtgctctttccatcagccagtttcccattatcatagctgatgacatgcacacccaccatctggggcaggctttagtacagcactctgtgccatcatccagatcaccaaatcttagtaaatggacgtgtcataagagataaggctgccatagaatcacagcagcttctggcttagtaaattacctggatacacaccttttcctagaggaaatcccacatcttcgtaggagatctggtgtaatgctcttgggacctctctctagaggatgagctagtatcactgggtcctagtaagtttcagcaaatataatagagacagaactgtcatcattatcagaaaagaaacagagaaaaatgttaaaacaatggttttgtgaccttaaagtctgtgttagtcccttagcaccaccgctgagattttgctgaaagggacgttttgtgtgttgggcttcactgaaggaagcccctgaaagtgttcagaaatagggaaaatgagaaactgttccagctgaaaatacgggcaagggggaatcattgaagaagacagaatattgaagtgttcaaatgaataaagaagctaaaaacta

SEQ ID NO: 355488 - DNA, 2067 bp, Homo sapiens
agctcgttcgccgcactttggaggcttcggctgcccctccgacccacgtagggcccggacccgggcctccttgtgaacagcgtgccggcttcgccccacgggttcaccggctggctgggcttcaagcgccgaggccgccgcagtgaccccgcccccgggccgaggatgtgaggcgggccgggcgtccccacaccgggcccgggcgccgggagtgggcgtctgggcagcgccaggcgatggccctgctgctggtgctcctcgcctcttggggcctggggcagtgagggggccggcgggcgtgggccgagtggccgcgggcgccatggagggggtgctgtacaagtggaccaactatctgagcggttggcagcctcgatggttccttctctgtgggggaatattgtcctattatgattctcctgaagatgcctggaaaggttgcaaagggagcatacaaatggcagtctgtgaaattcaagttcattctgtagataatacacgcatggacctgataatccctggggaacagtatttctacctgaaggccagaagtgtggctgaaagacagcggtggctggtggccctgggatcagccaaggcttgcctgactgacagtaggacccagaaggagaaagagtttgctgaaaacactgaaaacttgaaaaccaaaatgtcagaactaagactctactgtgacctccttgttcagcaagtagataaaacaaaagaagtgaccacaactggtgtgtccaattctgaggagggaattgatgtgggaactttgctgaaatcaacctgtaatacttttctgaagaccttggaagaatgcatgcagatcgcaaatgcagccttcacctctgagctgctctaccgcactccaccaggatcacctcagctggccatgctcaagtccagcaagatgaaacatcctattataccaattcataattcattggaaaggcaaatggagttgagcacttgtgaaaatggatctttaaatatggaaataaatggtgaggaagaaatcctaatgaaaaataagaattccttatatttgaaatctgcagagatagactgcagcatatcaagtgaggaaaatacagatgataatataacagtccaaggtgaaataaggaaggaagatggaatggaaaacctgaaaaatcatgacaataacttgactcagtctggatcagactcaagttgctctccggaatgcctctgggaggaaggcaaagaagttatcccaactttctttagtaccatgaacacaagctttagtgacattgaacttctggaagacagtggcattcccacagaagcattcttggcatcatgttatgctgtggttccagtattagacaaacttggccctacagtgtttgctcctgttaagatggatcttgttggaaatattaagaaagtaaatcagaagtatataaccaacaaagaagagtttaccactctccagaagatagtgctgcacgaagtggaggcggatgtagcccaggttaggaactcagcgactgaagccctcttgtggctgaagagaggtctcaaatttttgaagggatttttgacagaagtgaaaaatggggagaaggatatccagacagccctaaataatgcatatggtaaaacattgcggcaacaccatggctgggtagttcgaggggtttttgcgggacacacaaatgtctgatggtggcccaggagggctgtcactcagaatcaggcgggtgcagagtggcctgcaggacatgatgacccagcatgagacaggatgcatcacatctgggtgacgcctctctccaggggatcagcctggactaaatgcctctcctgggccaggatgcccagcaagccccgagatgcctcctggagagaaggaagtatgtgagagtatcctgagttaagtgagatctaaaatgcctgagaaaaccctgaaatgactgagtctatctggaacttatttgattgtttttctgccatcagatagaatgaggtctcaaaagagaaattaaattatattacaagaaaataaagctcaattgcttgcctatttga

SEQ ID NO: 355489 - DNA, 2900 bp, Homo sapiens
agctcgttcgccgcactttggaggcttcggctgcccctccgacccacgtagggcccggacccgggcctccttgtgaacagcgtgccggcttcgccccacgggttcaccggctggctgggcttcaagcgccgaggccgccgcagtgaccccgcccccgggccgaggatgtgaggcgggccgggcgtccccacaccgggcccgggcgccgggagtgggcgtctgggcagcgccaggcgatggccctgctgctggtgctcctcgcctcttggggcctggggcagtgagggggccggcgggcgtgggccgagtggccgcgggcgccatggagggggtgctgtacaagtggaccaactatctgagcggttggcagcctcgatggttccttctctgtgggggaatattgtcctattatgattctcctgaagatgcctggaaaggttgcaaagggagcatacaaatggcagtctgtgaaattcaagttcattctgtagataatacacgcatggacctgataatccctggggaacagtatttctacctgaaggccagaagtgtggctgaaagacagcggtggctggtggccctgggatcagccaaggcttgcctgactgacagtaggacccagaaggagaaagagtttgctgaaaacactgaaaacttgaaaaccaaaatgtcagaactaagactctactgtgacctccttgttcagcaagtagataaaacaaaagaagtgaccacaactggtgtgtccaattctgaggagggaattgatgtgggaactttgctgaaatcaacctgtaatacttttctgaagaccttggaagaatgcatgcagatcgcaaatgcagccttcacctctgagctgctctaccgcactccaccaggatcacctcagctggccatgctcaagtccagcaagatgaaacatcctattataccaattcataattcattggaaaggcaaatggagttgagcacttgtgaaaatggatctttaaatatggaaataaatggtgaggaagaaatcctaatgaaaaataagaattccttatatttgaaatctgcagagatagactgcagcatatcaagtgaggaaaatacagatgataatataacagtccaaggtgaaataaggaaggaagatggaatggaaaacctgaaaaatcatgacaataacttgactcagtctggatcagactcaagttgctctccggaatgcctctgggaggaaggcaaagaagttatcccaactttctttagtaccatgaacacaagctttagtgacattgaacttctggaagacagtggcattcccacagaagcattcttggcatcatgttatgctgtggttccagtattagacaaacttggccctacagtgtttgctcctgttaagatggatcttgttggaaatattaagaaagtaaatcagaagtatataaccaacaaagaagagtttaccactctccagaagatagtgctgcacgaagtggaggcggatgtagcccaggttaggaactcagcgactgaagccctcttgtggctgaagagaggtctcaaatttttgaagggatttttgacagaagtgaaaaatggggagaaggatatccagacagccctaaataatgcatatggtaaaacattgcggcaacaccatggctgggtagttcgaggggtttttgcggtgtaggaatgtgggtgtagacggaactccagaaaccatcatggaccatgaggcaactctgaggatggaagccacacactaaggacggtaaagcagaaagaagagctgaaaccctgatgataaagaagcagccaattccgtcctgcactgcccacctccagatctcattcatgtgaaacaaagagaaactttatcttgttcaagtcactttagtcaagatttttattatcagatgaatgcaatttctaattgatacaccttaaaattttcaacatgtacacctgatttaacaaaatctagaattaagtcaatacttctacatgcattatagaccaaaggtcactgctataagaactttgggtatatagtcaaattcctcacatttttagaaacttgtttattcattgcatccctcccccatctcactctctcacacactcacatatttattttctcagatccttataagttcataagacatatgtccttattccatttttacagatgagaaaactggggtttgcaggggttaagtaacttatccaagatcacacaattaattagtggcgaagtcataatttgaagtctttctaatgcccaaatgtttccattgtgtcacatatcggagctgtgctctttccatcagccagtttcccattatcatagctgatgacatgcacacccaccatctggggcaggctttagtacagcactctgtgccatcatccagatcaccaaatcttagtaaatggacgtgtcataagagataaggctgccatagaatcacagcagcttctggcttagtaaattacctggatacacaccttttcctagaggaaatcccacatcttcgtaggagatctggtgtaatgctcttgggacctctctctagaggatgagctagtatcactgggtcctagtaagtttcagcaaatataatagagacagaactgtcatcattatcagaaaagaaacagagaaaaatgttaaaacaatggttttgtgaccttaaagtctgtgttagtcccttagcaccaccgctgagattttgctgaaagggacgttttgtgtgttgggcttcactgaaggaagcccctgaaagtgttcagaaatagggaaaatgagaaactgttccagctgaaaatacgggcaagggggaatcattgaagaagacagaatattgaagtgttcaaatgaataaagaagctaaaaacta

SEQ ID NO: 355490 - DNA, 2205 bp, Homo sapiens
agctcgttcgccgcactttggaggcttcggctgcccctccgacccacgtagggcccggacccgggcctccttgtgaacagcgtgccggcttcgccccacgggttcaccggctggctgggcttcaagcgccgaggccgccgcagtgaccccgcccccgggccgaggatgtgaggcgggccgggcgtccccacaccgggcccgggcgccgggagtgggcgtctgggcagcgccaggcgatggccctgctgctggtgctcctcgcctcttggggcctggggcagtgagggggccggcgggcgtgggccgagtggccgcgggcgccatggagggggtgctgtacaagtggaccaactatctgagcggttggcagcctcgatggttccttctctgtgggggaatattgtcctattatgattctcctgaagatgcctggaaaggttgcaaagggagcatacaaatggcagtctgtgaaattcaagttcattctgtagataatacacgcatggacctgataatccctggggaacagtatttctacctgaaggccagaagtgtggctgaaagacagcggtggctggtggccctgggatcagccaaggcttgcctgactgacagtaggacccagaaggagaaagagtttgctgaaaacactgaaaacttgaaaaccaaaatgtcagaactaagactctactgtgacctccttgttcagcaagtagataaaacaaaagaagtgaccacaactggtgtgtccaattctgaggagggaattgatgtgggaactttgctgaaatcaacctgtaatacttttctgaagaccttggaagaatgcatgcagatcgcaaatgcagccttcacctctgagctgctctaccgcactccaccaggatcacctcagctggccatgctcaagtccagcaagatgaaacatcctattataccaattcataattcattggaaaggcaaatggagttgagcacttgtgaaaatggatctttaaatatggaaataaatggtgaggaagaaatcctaatgaaaaataagaattccttatatttgaaatctgcagagatagactgcagcatatcaagtgaggaaaatacagatgataatataacagtccaaggtgaaataaggaaggaagatggaatggaaaacctgaaaaatcatgacaataacttgactcagtctggatcagactcaagttgctctccggaatgcctctgggaggaaggcaaagaagttatcccaactttctttagtaccatgaacacaagctttagtgacattgaacttctggaagacagtggcattcccacagaagcattcttggcatcatgttatgctgtggttccagtattagacaaacttggccctacagtgtttgctcctgttaagatggatcttgttggaaatattaagaaagtaaatcagaagtatataaccaacaaagaagagtttaccactctccagaagatagtgctgcacgaagtggaggcggatgtagcccaggttaggaactcagcgactgaagccctcttgtggctgaagagaggtctcaaatttttgaagggatttttgacagaagtgaaaaatggggagaaggatatccagacagccctaagaaatccaacagaaaacacttgacaccaaaacataccctgatgaagatcctgaacttcaagaatgaagaaagaattcctcaccattcaggcagaaaaagcaagtcaccaagggacctcaaacttcctttccacaagattctgtgacgggaaacaatgggggagtatttccgaagttctgagtaggaaaaaagaatgactcaaatgtattattgccaaccaagtcgtcaaatctaatgtcaagttctcttaagcaggtaagaactcagaacataatacctgagtgccttcttaaggaaaccatttgataggaaagatgaaccaaataactcaatgatggatgagctggtagaaaaaaagctggtggtgaaccaaggtcaaactggaaattatagtcacagtatagatatagattataaatattacaaaccctaagatagctaataaattgggaatgggagaagggaggatataagagcactaatgccctcttattttcatagcagagacttgatactgtctcaacttttttcaaaaacacaatttcttaaattttttggtaatcttttaaataaacagatttct

SEQ ID NO: 355491 - DNA, 2838 bp, Homo sapiens
agctcgttcgccgcactttggaggcttcggctgcccctccgacccacgtagggcccggacccgggcctccttgtgaacagcgtgccggcttcgccccacgggttcaccggctggctgggcttcaagcgccgaggccgccgcagtgaccccgcccccgggccgaggatgtgaggcgggccgggcgtccccacaccgggcccgggcgccgggagtgggcgtctgggcagcgccaggcgatggccctgctgctggtgctcctcgcctcttggggcctggggcagtgagggggccggcgggcgtgggccgagtggccgcgggcgccatggagggggtgctgtacaagtggaccaactatctgagcggttggcagcctcgatggttccttctctgtgggggaatattgtcctattatgattctcctgaagatgcctggaaaggttgcaaagggagcatacaaatggcagtctgtgaaattcaagttcattctgtagataatacacgcatggacctgataatccctggggaacagtatttctacctgaaggccagaagtgtggctgaaagacagcggtggctggtggccctgggatcagccaaggcttgcctgactgacagtaggacccagaaggagaaagagtttgctgaaaacactgaaaacttgaaaaccaaaatgtcagaactaagactctactgtgacctccttgttcagcaagtagataaaacaaaagaagtgaccacaactggtgtgtccaattctgaggagggaattgatgtgggaactttgctgaaatcaacctgtaatacttttctgaagaccttggaagaatgcatgcagatcgcaaatgcagccttcacctctgagctgctctaccgcactccaccaggatcacctcagctggccatgctcaagtccagcaagatgaaacatcctattataccaattcataattcattggaaaggcaaatggagttgagcacttgtgaaaatggatctttaaatatggaaataaatggtgaggaagaaatcctaatgaaaaataagaattccttatatttgaaatctgcagagatagactgcagcatatcaagtgaggaaaatacagatgataatataacagtccaaggtgaaataaggaaggaagatggaatggaaaacctgaaaaatcatgacaataacttgactcagtctggatcagactcaagttgctctccggaatgcctctgggaggaaggcaaagaagttatcccaactttctttagtaccatgaacacaagctttagtgacattgaacttctggaagacagtggcattcccacagaagcattcttggcatcatgttatgctgtggttccagtattagacaaacttggccctacagtgtttgctcctgttaagatggatcttgttggaaatattaagaaagtaaatcagaagtatataaccaacaaagaagagtttaccactctccagaagatagtgctgcacgaagtggaggcggatgtagcccaggttaggaactcagcgactgaagccctcttgtggctgaagagaggtctcaaatttttgaagggatttttgacagaagtgaaaaatggggagaaggatatccagacagccctaagtgtaggaatgtgggtgtagacggaactccagaaaccatcatggaccatgaggcaactctgaggatggaagccacacactaaggacggtaaagcagaaagaagagctgaaaccctgatgataaagaagcagccaattccgtcctgcactgcccacctccagatctcattcatgtgaaacaaagagaaactttatcttgttcaagtcactttagtcaagatttttattatcagatgaatgcaatttctaattgatacaccttaaaattttcaacatgtacacctgatttaacaaaatctagaattaagtcaatacttctacatgcattatagaccaaaggtcactgctataagaactttgggtatatagtcaaattcctcacatttttagaaacttgtttattcattgcatccctcccccatctcactctctcacacactcacatatttattttctcagatccttataagttcataagacatatgtccttattccatttttacagatgagaaaactggggtttgcaggggttaagtaacttatccaagatcacacaattaattagtggcgaagtcataatttgaagtctttctaatgcccaaatgtttccattgtgtcacatatcggagctgtgctctttccatcagccagtttcccattatcatagctgatgacatgcacacccaccatctggggcaggctttagtacagcactctgtgccatcatccagatcaccaaatcttagtaaatggacgtgtcataagagataaggctgccatagaatcacagcagcttctggcttagtaaattacctggatacacaccttttcctagaggaaatcccacatcttcgtaggagatctggtgtaatgctcttgggacctctctctagaggatgagctagtatcactgggtcctagtaagtttcagcaaatataatagagacagaactgtcatcattatcagaaaagaaacagagaaaaatgttaaaacaatggttttgtgaccttaaagtctgtgttagtcccttagcaccaccgctgagattttgctgaaagggacgttttgtgtgttgggcttcactgaaggaagcccctgaaagtgttcagaaatagggaaaatgagaaactgttccagctgaaaatacgggcaagggggaatcattgaagaagacagaatattgaagtgttcaaatgaataaagaagctaaaaacta

SEQ ID NO: 355492 - DNA, 543 bp, Homo sapiens
catttccacgagtcaccactttatgaatctgtatcccatatgccggtgactcgtggaaatgtccacacatttccacgagtcacaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtg

SEQ ID NO: 355493 - DNA, 1177 bp, Homo sapiens
aacacccactaaaacctcaaagtgcttttcatttaggagacacggggaagagacagagaggagggtaaagtgagaatcctgcccgcaccacaggtctggactgctaaccttgaatcctggtttcttaaattctgcctccgcttctgactgaggaccactggattttgaggaaactttggtcttaattcccgtactgattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtg

SEQ ID NO: 355494 - DNA, 1336 bp, Homo sapiens
tccgcggctgcggaaggggacgcgaaccgtcctggtcccatccgagccgccgtagcgcgagtgccgcgggagttcggcagcccaggtcgccaaggcaacgggctccgctgcgggttgcgggctgcgggcgctaggctgccccggggaggcgctgcggaccggcggcccaggcacggagaggcggcgagaccgcaggagacacggggaagagacagagaggagggtaaagtgagaatcctgcccgcaccacaggtctggactgctaaccttgaatcctggtttcttaaattctgcctccgcttctgactgaggaccactggattttgaggaaactttggtcttaattcccgtactgattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtg

SEQ ID NO: 355495 - DNA, 1339 bp, Homo sapiens
tgagccgccggggatcccggggagggaggctgcggcccgatctttgtccctcagccgcgccggggacggcgcccccgacgccctttgaccccgccccgcgttcagggagagtccgttttcggctgtttattatatttgtagccattggtcgacctcattcgaaagtttcttaaaaaaaaaatcccttcttgtttgggggccagaaaataactcaaaactgtgcagaaaatttatttgtgtgtgtgactcttctggggccagagaggattgacttctttgtgcgtcagttttatcgtctgcaaaatgggaatcatggtagcacctgtctgatgacgttattacaagaattcccgtactgattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtg

SEQ ID NO: 355496 - DNA, 1611 bp, Homo sapiens
tccgcggctgcggaaggggacgcgaaccgtcctggtcccatccgagccgccgtagcgcgagtgccgcgggagttcggcagcccaggtcgccaaggcaacgggctccgctgcgggttgcgggctgcgggcgctaggctgccccggggaggcgctgcggaccggcggcccaggcacggagaggcggcgagaccgcaggagacacggggaagagacagagaggagggtaaagtgagaatcctgcccgcaccacaggtctggactgctaaccttgaatcctggtttcttaaattctgcctccgcttctgactgaggaccactggattttgaggaaactttggtcttaattcccgtactgattagtcaacagtggaaaatctgaagagatgcaagcaggaaaaagaaattaaaccagtaagatagagactgccactctctgggaaccttgctgtgtagctgagcctcagcaagtttgataatacagacacagcaggaggcctggggaggacccagcatgcccggccaccaagcagtgatgcagctggactgttccgcagctttccagagacctccatggaagcacagacttccatgggttgaagagagtttgtgtcacaattccagtccctagccctggccctgtgtgaagtagtaacaccgccctgccagtaggatatagctgctgaggaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtg

SEQ ID NO: 355497 - DNA, 1084 bp, Homo sapiens
acaagaattcacagtgattccggttatgattttggacatacaggggggctgtgaatgcacagagaaaacagttaacctggatttctggagaattcccgtactgattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtg

SEQ ID NO: 355498 - DNA, 1149 bp, Homo sapiens
aaaagtctgagcccatgttctttaaaatgttgatggtggttgtctgggtgtggaattatgagtgacttgttttgttctttgtacttttctgtgctttttgctttgttttcaataagaggcaataactgtcattttgacagaagccactgtgctggggaactggagctgtcctctctgcagaatgcatctggacttacctctgcccccttgccttctgtccccacagcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtg

SEQ ID NO: 355499 - DNA, 1091 bp, Homo sapiens
gtgacacactggggacttaacatctggcctctccctctggggaacctgcacaaacaaagcaaccttcaagagcccttcacttgatgctttaagcacccatccataatggcccttaattgactcttaattatactaacaaacactatgtgtatttccatgtaaaaagatgttacagaccaggctaaagtccataggccaccaccacctcagtccagctccagctcgtcttgctccccagggcatatccactgctatcagtttggctgggccctttcacacctccttctgtgcattactttgtgtatatgtgcccaagaaaaacctctttctctcctctccagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtg

SEQ ID NO: 355500 - DNA, 1685 bp, Homo sapiens
aacacccactaaaacctcaaagtgcttttcatttaggagacacggggaagagacagagaggagggtaaagtgagaatcctgcccgcaccacaggtctggactgctaaccttgaatcctggtttcttaaattctgcctccgcttctgactgaggaccactggattttgaggaaactttggtcttaattcccgtactgattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtgaaaaaaaaaaaacaaaacacacacagaacaccacccacgcaacacaccacgcagcaaccaaacaacaccaacaaaaacaacgacacaacacaaaaaaacaagcgcgcgcggcacaaaaaaataacgcaccagaggggccacccacaaacgagcaccaaacacaagagcaatggatgaaaaaagaggggcccccacaaacacgagagcgcgctacataaagacagcaaacgagagcgagcgcattacaaacacgcgaaatcgacaggaaacaacagacaacagcaagaacgaacctgcgcggaagaaccaagacaaccaccagaccgagggggaaaaaaacagagaaagagacaacaaacaccacaccaaaagcagaaaaacagcacgccacgagaaaaacaacaacacaatagaacgaacaacagaggaaccacaacaaagagacagcacagagcccgaccagaagcaaaacatcgacacacgagaaaataggacaaacacaatacag

SEQ ID NO: 355501 - DNA, 1329 bp, Homo sapiens
  misc_feature (1322)..(1323): n is a, c, g, or t
aacacccactaaaacctcaaagtgcttttcatttaggagacacggggaagagacagagaggagggtaaagtgagaatcctgcccgcaccacaggtctggactgctaaccttgaatcctggtttcttaaattctgcctccgcttctgactgaggaccactggattttgaggaaactttggtcttaattcccgtactgattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctagcagaataatgcgtattggtgacaaaaaaacaaccgcggcttttcgggtggaaaaggtataaggctgcttgtgtcggccgctttcagggatcggccctggcgtatgacggtctcccagcagcagaagtgaaaaaaaaggcccctcccttgctatattagcgtactcgggcttgggnnaaagaa

SEQ ID NO: 355502 - DNA, 1909 bp, Homo sapiens
aacacccactaaaacctcaaagtgcttttcatttaggagacacggggaagagacagagaggagggtaaagtgagaatcctgcccgcaccacaggtctggactgctaaccttgaatcctggtttcttaaattctgcctccgcttctgactgaggaccactggattttgaggaaactttggtcttaattcccgtactgattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtgaaaaaaaaaaaaaaaaaaaaaaaaaaaaaaaaaaaaaaaaaaaaaaaaaaaaaaaaaaaaaaaagagggggggcggcggcaaaaaaaaaccccgggggggcccaaaaagcccacccttttgtgaaaaaggggggccccaagggggggtattaataacgaccagcggagcggaccaggccggccgactataaaacaaagcgcgcgggcgagaggaacaaaaggtgtgtacttgggtcgcaatctggagggagacgaaccccttatctcgtggggggggggaccaactaatgggcaacacacccacccacgcaaagattaatcagcggctcggagagaaaaattaacaaattgagggctccttgtcggtctggccaacccacgacggcttaatagacgcagcaaaacaaattggtccaaccaaggaaggaaacaaacttcggaaaacatttcttcccggcggcgcctgtctgtagcaaaatcaacgcggggcgcgaagagaagaacgagagaacaagaagacgacgagaacaaacaacgaggacgaaggagagagaagaaagaagaaaaagacagaagggaagagagagagaagcgaatcagaacaaatcaaagagagggaacgacacaaggagagaggagacaggagacgcggaggcaaggcagcggacaaaaagaaagaagacgacacggcgtccgagcaacaagtgaaacaggggagcagcgaggaaaaga

SEQ ID NO: 355503 - DNA, 1260 bp, Homo sapiens
aacacccactaaaacctcaaagtgcttttcatttaggagacacggggaagagacagagaggagggtaaagtgagaatcctgcccgcaccacaggtctggactgctaaccttgaatcctggtttcttaaattctgcctccgcttctgactgaggaccactggattttgaggaaactttggtcttaattcccgtactgattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtgcagtttagctaaaatggcttaaaaaatgtgaattgattgtcagctctctccatatcgtcgacgcggccgcgaatttagtagta

SEQ ID NO: 355504 - DNA, 942 bp, Homo sapiens
aacacccactaaaacctcaaagtgcttttcatttaggagacacggggaagagacagagaggagggtaaagtgagaatcctgcccgcaccacaggtctggactgctaaccttgaatcctggtttcttaaattctgcctccgcttctgactgaggaccactggattttgaggaaactttggtcttaattcccgtactgattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccgggaaagccctctgcccacacccacaggctttacattcccaccacctttactcgaaa

SEQ ID NO: 355505 - DNA, 1760 bp, Homo sapiens
aacacccactaaaacctcaaagtgcttttcatttaggagacacggggaagagacagagaggagggtaaagtgagaatcctgcccgcaccacaggtctggactgctaaccttgaatcctggtttcttaaattctgcctccgcttctgactgaggaccactggattttgaggaaactttggtcttaattcccgtactgattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtgaaaaaaaaaaaaaaaaaaaaaaaaaaaaaaaaaaaaaaaaaaaaaaaaaaaaaaaaaaaaaaaagagggggggcggcggcaaaaaaaaaccccgggggggcccaaaaagcccacccttttgtgaaaaaggggggccccaagggggggtattaataacgaccagcggagcggaccaggccggccgactataaaacaaagcgcgcgggcgagaggaacaaaaggtgtgtacttgggtcgcaatctggagggagacgaaccccttatctcgtggggggggggaccaactaatgggcaacacacccacccacgcaaagattaatcagcggctcggagagaaaaattaacaaattgagggctccttgtcggtctggccaacccacgacggcttaatagacgcagcaaaacaaattggtccaaccaaggaaggaaacaaacttcggaaaacatttcttcccggcggcgcctgtctgtagcaaaatcaacgcggggcgcgaagagaagaacgagagaacaagaagacgacgagaacaaacaacgaggacgaaggagagagaagaaagaagaaaaagacagaagggaagagagagagaagcgaatcagaacaaatcaaagagagggaacgacacaaggagagaggagacaggagacgcggaggcaaggcagcggacaaaaagaaagaagacgacacggcgtccgagcaacaagtgaaacaggggagcagcgaggaaaaga

SEQ ID NO: 355506 - DNA, 899 bp, Homo sapiens
tgagccgccggggatcccggggagggaggctgcggcccgatctttgtccctcagccgcgccggggacggcgcccccgacgccctttgaccccgccccgcgttcagggagagtccgttttcggctgtttattatatttgtagccattggtcgacctcattcgaaagtttcttaaaaaaaaaatcccttcttgtttgggggccagaaaataactcaaaactgtgcagaaaatttatttgtgtgtgtgactcttctggggccagagaggattgacttctttgtgcgtcagttttatcgtctgcaaaatgggaatcatggtagcacctgtctgatgacgttattacaagaattcccgtactgattagtcaacagtggaaaatctgaagagatgcaagcaggaaaaagaaattaaaccagtaagatagagactgccactctctgggaaccttgctgtgtagctgagcctcagcaagtttgataatacagacacagcaggaggcctggggaggacccagcatgcccggccaccaagcagtgatgcagctggactgttccgcagctttccagagacctccatggaagcacagacttccatgggttgaagagagtttgtgtcacaattccagtccctagccctggccctgtgtgaagtagtaacaccgccctgccagtaggatatagctgctgaggaggtaagagttttaaaaaattcataccccaaaataattatttttactcttgctgtgaagttagataccaaagagtagaatgtggtggtagaatcaagagagtcaacccaacatcactgaaaagattctgaaggtttgtatccagctgaatatccaaaacaggatgttgcttaagcatgggtaaaatgcatctggtgtatgttttagacagc

SEQ ID NO: 355507 - DNA, 1189 bp, Homo sapiens
tccgcggctgcggaaggggacgcgaaccgtcctggtcccatccgagccgccgtagcgcgagtgccgcgggagttcggcagcccaggtcgccaaggcaacgggctccgctgcgggttgcgggctgcgggcgctaggctgccccggggaggcgctgcggaccggcggcccaggcacggagaggcggcgagaccgcagaattcccgtactgattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtg

SEQ ID NO: 355508 - DNA, 901 bp, Homo sapiens
tccgcggctgcggaaggggacgcgaaccgtcctggtcccatccgagccgccgtagcgcgagtgccgcgggagttcggcagcccaggtcgccaaggcaacgggctccgctgcgggttgcgggctgcgggcgctaggctgccccggggaggcgctgcggaccggcggcccaggcacggagaggcggcgagaccgcaggagacacggggaagagacagagaggagggtaaagtgagaatcctgcccgcaccacaggtctggactgctaaccttgaatcctggtttcttaaattctgcctccgcttctgactgaggaccactggattttgaggaaactttggtcttaattcccgtactgattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagagatggatctcactatgttgccctggctggtctcaaactcctaggctcaagcaatcctcctgcctcgcctcccaaagtgctgggatcacaggcatgaaccaccacgcctggcccagggggattccagttccaagccttaagacccaacaaagacacacttcagaactcaggagacaccatggtccctggttcttgtgatttctcccaactatgggtgggagacaagctcacccagggccagcctctccattccttctcacaggacccacctggtaggcctggacatgtccaggcaagaggctgcttcctgggatg

SEQ ID NO: 355509 - DNA, 1441 bp, Homo sapiens
tccgcggctgcggaaggggacgcgaaccgtcctggtcccatccgagccgccgtagcgcgagtgccgcgggagttcggcagcccaggtcgccaaggcaacgggctccgctgcgggttgcgggctgcgggcgctaggctgccccggggaggcgctgcggaccggcggcccaggcacggagaggcggcgagaccgcaggagacacggggaagagacagagaggagggtaaagtgagaatcctgcccgcaccacaggtctggactgctaaccttgaatcctggtttcttaaattctgcctccgcttctgactgaggaccactggattttgaggaaactttggtcttgtggtggtgaggaggtgatgttctggaaggaaggtacctagactttgtggtccctgccaggaagtggagagtggaaatgtggaatgcctcacactcctcaactagaattcccgtactgattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtg

SEQ ID NO: 355510 - DNA, 1397 bp, Homo sapiens
tccgcggctgcggaaggggacgcgaaccgtcctggtcccatccgagccgccgtagcgcgagtgccgcgggagttcggcagcccaggtcgccaaggcaacgggctccgctgcgggttgcgggctgcgggcgctaggctgccccggggaggcgctgcggaccggcggcccaggcacggagaggcggcgagaccgcaggagacacggggaagagacagagaggagggtaaagtgagaatcctgcccgcaccacaggtctggactgctaaccttgaatcctggtttcttaaattctgcctccgcttctgactgaggaccactggattttgaggaaactttggtcttaattcccgtactgattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcaggttagagccagcaggtccttggcactactgcatgccagaggccctctgccgggccccgggctagcctccaagtcctagactgcccatactttcttagagaagaaaccacatttaagtcaggcctgccccatggtcagtggcagagtccagcaatctctaggttggaagatgtttgagtctcaggccccaaggactcctctggacaggcatccgggactcttcctgtccccctgccccctagcccaggtccctccacttctcgctatccccacagctatacctggctctggccactcacagctctcacctggctgactttagcggccggcttccctgggctccctacacccatctccgcccttcctgttcagctctatgcagcagccagcagaccccatttaaaccattctgtccatcatgcttctgccaaaaaaaaaatcccccagtggcttcactgagtgaagctaagcttgtcacattgccctggggcagtcctgctgtaggccgggccctgcccaagtctcacccggtgccactcctctccctgacaccctccagctacatctacctttggtctgtttctcagtcaagcctctccaaggggccttctctgagtgctagatcagccttccccaatcacatgaccctcatcactctctgacaaggtctcaggggtctaaatgtgagcgccgggagggcagaggccttgcattctgtttggcacacagcaggtgcttggtaaccacagaccgaatgacaaaaggaaacagcatccacccacccaagtcctggctggaacacccccaccccc

SEQ ID NO: 355511 - DNA, 333 bp, Homo sapiens
gttttaggattatccatgcattgtcatttcccattaccacagataattgaaagttgactgtactggatagcactacctcagttagctgcccatcagtgtgggaaaacatctgcaatcaaacagttacagtggattaacccaactaaattgggtgtttttaaatatgtctcaattttttttattagtaagctaatgtttcaaataaacatttaaattacaattatgcttcaaattatgtatcattcataaaacaaattagttactaacagagtaattttcagtttttttatataaagtgatataaaaactacataggaaattaattgggaagta

SEQ ID NO: 355512 - DNA, 426 bp, Homo sapiens
atcttgcccaactctgaaggccccaacaacagacatcaagatggacatctctaatcttaggagtttggcgttttgagtgttcttcactctggcttgatattgtgagaatttgcatctccagtaggatggagctggtctaattttatgtgggaaaggcattggtctcattatatacataactgacatactaaacaagcacaaattgtgatgtaatcaaacacaagtgcattttttttgtctcccacttcacctttaaagtatatattttggaggaatcttttataatgttcctggatgaaaactttgcaagttcctggactttttcagtcattcttagataatagacatccctctagtaactttgagtcatgaaaatgatctcagtccagtaaccagaatgtctaggagaagacattaatgtaaact

SEQ ID NO: 355513 - DNA, 360 bp, Homo sapiens
caacttttgcttcctatctaatcaacatccaatggacggatgtttgtgtccccccaaaattcatattgttgaaatcctaacccacaaggtgaaggtattaaagtgtggggccttaaagaagcaattaggtaatcaggtcactagagtggagtcctcatgaatgtgattagtacccttagaaaaaggcgggagaaaacttgctttctatctctctgctctctgccatgtgaagatacgaggagaagactgctctctgtcaaccaagatgagggccttccccaagaacccagtcgtgttggcaccctgatcttaaacttcagcctccagagttgtaagaaataaatgtttttttgtttaagc

SEQ ID NO: 355514 - DNA, 457 bp, Homo sapiens
catactacaatcaaccaaacatcagccttcaagagatgcaccatatgactacatccacagagcatttgatgaatttctgtccataaaaaccctctgagagaagtcatgaaaacaaataagtctgttgagctttacatatgccggtcttagccaaatttgtctgaccacaagatcctttgatctccccataaaacattttctatcactgggggagctcaagtcctgtagagctcaccatgggatacactgctccatgacgactgtgtctctgcctcgtctacttccattgctcatccaggaattgagaagactttatcatttaagccatgagatggctgaggaagaaaaaaccagatgcctgtttaagtcacctttagatttccacttcttcttccactgaattgtccttgaaatttcctttggaaataaattccaaggtaataaaaggcctcagtgc

SEQ ID NO: 355515 - DNA, 685 bp, Homo sapiens
gcactttattgctagtacaggcaaaggcaaatatggtggatacatgccattgagcattatgctccttttaaaagagagaagaattagtgaaccatatacttctataaatggatctcatagagcagttatgattggaggtaaaaaccagaatgagatctagaatacaacctcaatatgtaagctgaaaatacacatgaacgacaaaagattttgtaagaaatgtatgatgaaaagctacacattaaacatatcagaatggttgctatggaaagggtgagagtgggaaatggggagagaaaggactaaaaagacccaatcaattataggaaagagaggctttgtgaagtaaatagtgataacgtattatgaacggagggatttgattccctcaatcctctgaaattatgttcttaataaaacaaaacatacacagccattgtatttttaggtgactacatacagtctccaagagggaaatgattttcccaaattacacagtgaagttaaagaagtccaggatcaattcagaggcacaatgacgtcatgatttttcattggcaactctggttcccctggtcttatggttgcaaagtggctgccacatcatgtcactttaaaatgtcttacttttaatttacataactgtattttaaaaggaagatttgaattgatacatatgtgggca

SEQ ID NO: 355516 - DNA, 2928 bp, Homo sapiens
  misc_feature (1)..(3): n is a, c, g, or t
  misc_feature (6)..(6): n is a, c, g, or t
nnnttnttttgtttttaattaatagactttatgttttttgagcaactttaggtttctaggaaaattgagcagaaagtacagcaagttcccttgtgcccccatggcctcagtttcccatgaccttagttccgctgccctcagtttcccctgctgctcctgtcttgccttggcgtgtctgtccctactgcagccaggctgatctgtcccagcgcacctcactcttgcctccagccatgggcacggcctcatcgcgtctgcgttccccgctggaggccttgtggaggccctcacccatggcagcttttgccttccctctagagtttaaagaaacccattatccccaaagagtttgggggcaaagtccccaccgtcatccgccagcgctatctcaacctgttcatcgaggagtgtctcaagttctgtacctccaaccaggaggccatagagaaggtgaggtcctggagttcctatctggccggtcgggtggggactaggggtccagggtggtccccagacatcccccggcctctcagccgcagctgtgacccggagctgcctgggagagatgcaagtccccgaccccatggcgaccccaccgctggggctccccggcaccaggcaggcatggcctcagctgggcaccgcctgtcccccaggcactgaacgaggagaaggtggcctatgaccgcagccccagcaagaacatctacctgaatgtggccgtgaacaccctcaagaagctcaggggcctggcccccagcgctgtgcccggcctcagcagtgagtcctggcgggtgggcgggggaggctcagggttgctcttggggtggcagctgggctgggaccctcgctgggaccttcacagccctgagctcagccacagtctcagacaaaaggaaagcgcggtgctgtgggggggctgcctgctgcctggttcccaggcttctgtgtaggacggacctggccctggtgtcctcgctgtcagccgccttcctccgctgagtggggtctccaagccgagccgaggggccgcctgctaatggagctgcggcagcttcttcaaagcaggaggcccagggctgggcgagctccatgcattaagctctggggaggaagaaagcggagacctgggcgtttcattgcagcctctccaggctgcattaagctatcaccggcccctgcccccgtccccgcctgcattagcactcggaggggccctgggttggcgtcgcaggctgggtggcccatgaaggctcaaagccctcgaaagccattagatcccccgtgctgttctccccgcccttcccccttcgcttgaggggaggggacgaagactttgggtgtggggcctccgtgcagctctggggcctgcagagctggcggctgccctgcgtccctggctcaccgcatgtctgcctctcctgttcgggtcaggctggaacccggggtcagtggggtgctgtcccagaaagggggagttgaggcagaggtctgaggagggcagggtgggtgggagagcaggcggggcaggggtctgagccagctacttcacaccctcctcccctccctcccttccttccagaaaccagtggccgcagggttgtgtcccacgaggtggtgttggggggcaggttggccgccaagaccagcttctcgctcagccgtccaagcagcccccgggtggaggacctgaaaggtaaggccctgcccctgctctgccacacggtgcttcgtgggcctctgccggcccagcccctgctgtgccacacggtgcttcgtgggcccctgccggcccagccgcctttcccggtggtgtctaccgccccgtgggccatcccaggcaggggctgaccactgtgcctgtccacaggggctgccctgtacagccgcctcagggagtacctgctcacccaggaccagctcaaggagaacggctaccccttcccgcacccagagcggcccgggggcgcaatcatcttcacagctgaggagaagaggcccaaggactgtgagtcgctggcctgcgacggcctaggtgggcaggtgcgggatgtgggcaaggccgggcatgcgggccccagcgtgagcctcagcttccacctgggtccccacccacagcttcctgcaggacctgctgccgctgtggcaccgagtacctcgtgtcctcttcaggccgctgcatccgggacgaggagtgttattaccactggggacggctgcgccggaaccggggtaaggccttacccgggtccttccccttcccacccatggcccccggaacctgggccctcccttgaggcccccagaactggggtaaggctttacccaggccctccatcccactcagggtccctgggctgcaccgtctttggcagagccggggctagcccttggcctcattttctctccacctgttctttatgcaaaagtaagacaagagctttcccatgacaaggttcaaatgccaccacctgaaaggccctgtgtccctgccttcctgtgcccttggtccatggaaatgtggaggttgctggccccaggagcggaggggcttgtcccacccttggcctggtggttctattcaatcccccaggcaaccacgcagccacgctcagggcacatggccagccttgcacagccctgtggcggcccctaaagccatcgcctcagggatacctggagggtgctgcccggggcagcgctgccaagaggcctctgcagagggcactggtctccctggatccaggcctgggcgtcctggctgccacacgactgccggggcctggtctgcttccagctccaccaagaggctgaggcctcctgtcctcagtcctcactccctagtagggctcggtagatgcaggtggtcagtgccccgggggctgtggagtgggcctggccgggccctgactgtgtgtctgtgtcccc

SEQ ID NO: 355517 - DNA, 4761 bp, Homo sapiens
ggagcaagatggcggcggcggggtccgtgaggcgcgggcggcggcgaccgcggcgccagtgagggggccctggggcccgggcggctccgggccggggccccgccgcgggacggaccatgctacgctccactggcttcttccgggccattgactgcccctattggtctggggcgcccggggggccctgccggcggccctactgccacttccggcaccgcggggcccggggccccggcgcgcccggtgacggcggagaggcgccccccgcagcagtgaaggctgcaccagacgcatctgtacctgccctgtgcggtctgtctgtggcacgggttctgaggattccgagtctgaaggtggtggtgttgaagctgcatgggatggttgcgaaactgctctgcaagatctcggcctgtccatggccccctcagtgacggggctgggttacgacccctacaaccctgagctgcccaagccccccgcgcagagggagaatggcaccctgggcctgggggaggagccgcgcccggatgtgctggagttggagctggtcaaccaggccatcgaggccgtgcgcagtgaggtggagctggagcagcggcgctaccgggagctgctggagacgacccgtgagcaccgctccgccgaggcccccgccctggcgccccgcggccccaacgccagccccactgtgggcccggacgaggatgccttcccactggccttcgactacagccccggcagccacggcctattaagccctgatgccggctaccagcccaccccactggccgcccctgccgagccgggcagcaagtactcgctggcgtccctggacaggggtcagggcagaggtggagggggtggcggtgccctggaatacgtccccaaggctgtgagccagccccggcggcacagccgccccgttcccagtggcaagtacgtggtggacaactccaggccacccacagacctggagtatgaccctctctccaactactcggcccggcacctcagcagggccagctcccgggatgagcgggccgccaagcggccccggggctcccgcggcagtgagccctacacacctgctcccaagaagctctgtgacccctttggcagttgcgatgcaaggttctcagactcagaagatgaggccgccacggtcccaggtaacgagcccaccacggccagcacccccaaagccagggccgaccctgagatcaaggccaccgggcagccaccctccaaagagggcctggaggccgaggggggcggcctgcgggagaccaaggagacggccgtgcagtgcgacgtgggggacctccagccgcccccagccaagcccgcctccccagcccaggtccagtcctcacaggatgggggctgccccaaggagggaaaacccaagaagaaaaaaaccggggccccacctgcccccagctgcaaagacggggcccaggggaaggacaagaccaaggacaagggccgagggcggcctgtggagaagccccgtgcggacaagaagggcccgcaggccagcagcccccggcgcaaggcagagcggccggaagggaccaagaagaagccatcttcggccactcctgtggccacctcagggaaagggaggcctgaccggccagcgcggcggccgagccccacaagcggggactcccgaccggcggccggcagaggcccaccccgccccctccagctgcccgacaggaagagcaccaaggccccgtcggggaagctagtggagcggaaagcccgctcactagacgagggcgcctcccaggacgcccccaagctgaagaagcgggccctgagccacgccgacctctttggggacgagagtgaggacgaggccgcagggccaggggtgccgagcgtgtggccctctgccctccccagcctcagctcggactcagactccgactcagactccagcctgggcttcccggaggcgcaggggccgcccaagcggctcaaggcctccccgcccccctcccccgccccatcctcctcctcctcctcctcctcctccacctccagcgcgggggcggatgtggactactcggccctggagaaggaggtggactttgactccgaccccatggaggagtgcctgcggatcttcaacgagtccaccagcgtcaagacggaggacagaggccggctggcccggcagccccccaaggaagagaagagtgaggagaaggggctttcgggtctgaccactctgttccccgggcagaagaggaggatctcccacctttccaagcaaggccaggaggtggagcccccgaggaggggtcccgcggtgcccccggcccggcccccgacggcgcaggaggtgtgctacctgcgggcccagcaggcgcagagggcatcggcgagcttgctgcaggcccccgccaggctggcagagaagtcgccctccgtccacatttccgcccctggcgagaagaggaggatcgcccacatccccaacccccgcctggctgcagcccccacaggtgccaagaggacccttgcggccagcggcagccagtcctccaacggccctgagccaggtggccagcagctgaaaacacgcacattgtcggggatggcgtccaagactaccaccaccatcatccctaagcgaatcgcccacagtccatccttacagagtttaaagaaacccattatccccaaagagtttgggggcaaagtccccaccgtcatccgccagcgctatctcaacctgttcatcgaggagtgtctcaagttctgtacctccaaccaggaggccatagagaaggcactgaacgaggagaaggtggcctatgaccgcagccccagcaagaacatctacctgaatgtggccgtgaacaccctcaagaagctcaggggcctggcccccagcgctgtgcccggcctcagcaaaaccagtggccgcagggttgtgtcccacgaggtggtgttggggggcaggttggccgccaagaccagcttctcgctcagccgtccaagcagcccccgggtggaggacctgaaaggggctgccctgtacagccgcctcagggagtacctgctcacccaggaccagctcaaggagaacggctaccccttcccgcacccagagcggcccgggggcgcaatcatcttcacagctgaggagaagaggcccaaggactcttcctgcaggacctgctgccgctgtggcaccgagtacctcgtgtcctcttcaggccgctgcatccgggacgaggagtgttattaccactggggacggctgcgccggaaccgggtggccggaggctgggagacccagtacatgtgctgctcggctgccgccggctctgtcggctgccaagtcgcaaagcaacacgtgcaggatggccggaaggagcgccttgagggcttcgtgaagacctttgagaaagagctctcaggagacacccacccggggatctacgccctggactgcgagatgtcctacaccacatatggcctggagctgacgcgcgtcacggtggtcgacacggacgtgcacgtggtttatgacaccttcgtgaagcctgacaacgagatcgtggactacaacaccaggttttcgggggtgacggaggctgaccttgccgacacaagtgtcacgctgcgtgacgtccaggccgttctgctgagcatgttcagcgctgacaccatcctcatcggacacagcctggagagcgacctcctggccctgaaggtcatccacagcaccgtggtggacacgtctgtgctcttcccccaccgcctgggcctcccctacaagcggtccctgcggaacctcatggccgactacctcagacagatcatccaggacaatgtggatgggcacagctccagcgaggacgccggcgcctgcatgcacctggtgatctggaaggttcgagaagacgccaagaccaagcgatgacgcctgcccgcctcccacccgcctctcctgccgtcccgctggtccttagccccatgcctcttccaaaacagtgcaataaatctccggtaacccgtccacctggccgaggcagcccagagcagcgggatgagctggcggccagagaacgcccagcccagcccacccccgctcacgtcctgccgcacccctccgccggtccccaccctctgccccccagccctctggcgtctctagaaactgctgctgatggagaccaggacagagcccgcccccacccggcccgcagcccctcctgcccctcctgccaggccctccctcccgggtggtggccggcacctctgctcctcacgtgggtcgcggggcgggcttgtcccaggtttgtttgagacagtctttttttattttgtattgttatttttattatttttaatttaaacctgatgacttgcacagcatctttcccaccgggaagagcgggcctgctgccttccctcctgcggggtgggggtgggacagaccccagtgggggccagggccacactcagcgcagtgtgggctggacccgcctctgtgctccaggggctggccggtcttcgggggcgccggcttccaccactcgccgccccacccctgcactccgtgacctctgagaacccagctggcccctcgttagccccagggtctgccgtctagagggagcccaccggcctccggacactgtcttcccgctagagccccgtcctcctctgcggggctctccggacccccttccccctcacctccaggcagggacagaataaatgtttgtatggatttta

SEQ ID NO: 355518 - DNA, 4618 bp, Homo sapiens
ggagcaagatggcggcggcggggtccgtgaggcgcgggcggcggcgaccgcggcgccagtgagggggccctggggcccgggcggctccgggccggggccccgccgcgggacggaccatgctacgctccactggcttcttccgggccattgactgcccctattggtctggggcgcccggggggccctgccggcggccctactgccacttccggcaccgcggggcccggggccccggcgcgcccggtgacggcggagaggcgccccccgcagcagggctgggttacgacccctacaaccctgagctgcccaagccccccgcgcagagggagaatggcaccctgggcctgggggaggagccgcgcccggatgtgctggagttggagctggtcaaccaggccatcgaggccgtgcgcagtgaggtggagctggagcagcggcgctaccgggagctgctggagacgacccgtgagcaccgctccgccgaggcccccgccctggcgccccgcggccccaacgccagccccactgtgggcccggacgaggatgccttcccactggccttcgactacagccccggcagccacggcctattaagccctgatgccggctaccagcccaccccactggccgcccctgccgagccgggcagcaagtactcgctggcgtccctggacaggggtcagggcagaggtggagggggtggcggtgccctggaatacgtccccaaggctgtgagccagccccggcggcacagccgccccgttcccagtggcaagtacgtggtggacaactccaggccacccacagacctggagtatgaccctctctccaactactcggcccggcacctcagcagggccagctcccgggatgagcgggccgccaagcggccccggggctcccgcggcagtgagccctacacacctgctcccaagaagctctgtgacccctttggcagttgcgatgcaaggttctcagactcagaagatgaggccgccacggtcccaggtaacgagcccaccacggccagcacccccaaagccagggccgaccctgagatcaaggccaccgggcagccaccctccaaagagggcctggaggccgaggggggcggcctgcgggagaccaaggagacggccgtgcagtgcgacgtgggggacctccagccgcccccagccaagcccgcctccccagcccaggtccagtcctcacaggatgggggctgccccaaggagggaaaacccaagaagaaaaaaaccggggccccacctgcccccagctgcaaagacggggcccaggggaaggacaagaccaaggacaagggccgagggcggcctgtggagaagccccgtgcggacaagaagggcccgcaggccagcagcccccggcgcaaggcagagcggccggaagggaccaagaagaagccatcttcggccactcctgtggccacctcagggaaagggaggcctgaccggccagcgcggcggccgagccccacaagcggggactcccgaccggcggccggcagaggcccaccccgccccctccagctgcccgacaggaagagcaccaaggccccgtcggggaagctagtggagcggaaagcccgctcactagacgagggcgcctcccaggacgcccccaagctgaagaagcgggccctgagccacgccgacctctttggggacgagagtgaggacgaggccgcagggccaggggtgccgagcgtgtggccctctgccctccccagcctcagctcggactcagactccgactcagactccagcctgggcttcccggaggcgcaggggccgcccaagcggctcaaggcctccccgcccccctcccccgccccatcctcctcctcctcctcctcctcctccacctccagcgcgggggcggatgtggactactcggccctggagaaggaggtggactttgactccgaccccatggaggagtgcctgcggatcttcaacgagtccaccagcgtcaagacggaggacagaggccggctggcccggcagccccccaaggaagagaagagtgaggagaaggggctttcgggtctgaccactctgttccccgggcagaagaggaggatctcccacctttccaagcaaggccaggaggtggagcccccgaggaggggtcccgcggtgcccccggcccggcccccgacggcgcaggaggtgtgctacctgcgggcccagcaggcgcagagggcatcggcgagcttgctgcaggcccccgccaggctggcagagaagtcgccctccgtccacatttccgcccctggcgagaagaggaggatcgcccacatccccaacccccgcctggctgcagcccccacaggtgccaagaggacccttgcggccagcggcagccagtcctccaacggccctgagccaggtggccagcagctgaaaacacgcacattgtcggggatggcgtccaagactaccaccaccatcatccctaagcgaatcgcccacagtccatccttacagcttttgccttccctctagagtttaaagaaacccattatccccaaagagtttgggggcaaagtccccaccgtcatccgccagcgctatctcaacctgttcatcgaggagtgtctcaagttctgtacctccaaccaggaggccatagagaaggcactgaacgaggagaaggtggcctatgaccgcagccccagcaagaacatctacctgaatgtggccgtgaacaccctcaagaagctcaggggcctggcccccagcgctgtgcccggcctcagcaaaaccagtggccgcagggttgtgtcccacgaggtggtgttggggggcaggttggccgccaagaccagcttctcgctcagccgtccaagcagcccccgggtggaggacctgaaaggggctgccctgtacagccgcctcagggagtacctgctcacccaggaccagctcaaggagaacggctaccccttcccgcacccagagcggcccgggggcgcaatcatcttcacagctgaggagaagaggcccaaggactcttcctgcaggacctgctgccgctgtggcaccgagtacctcgtgtcctcttcaggccgctgcatccgggacgaggagtgttattaccactggggacggctgcgccggaaccgggtggccggaggctgggagacccagtacatgtgctgctcggctgccgccggctctgtcggctgccaagtcgcaaagcaacacgtgcaggatggccggaaggagcgccttgagggcttcgtgaagacctttgagaaagagctctcaggagacacccacccggggatctacgccctggactgcgagatgtcctacaccacatatggcctggagctgacgcgcgtcacggtggtcgacacggacgtgcacgtggtttatgacaccttcgtgaagcctgacaacgagatcgtggactacaacaccaggttttcgggggtgacggaggctgaccttgccgacacaagtgtcacgctgcgtgacgtccaggccgttctgctgagcatgttcagcgctgacaccatcctcatcggacacagcctggagagcgacctcctggccctgaaggtcatccacagcaccgtggtggacacgtctgtgctcttcccccaccgcctgggcctcccctacaagcggtccctgcggaacctcatggccgactacctcagacagatcatccaggacaatgtggatgggcacagctccagcgaggacgccggcgcctgcatgcacctggtgatctggaaggttcgagaagacgccaagaccaagcgatgacgcctgcccgcctcccacccgcctctcctgccgtcccgctggtccttagccccatgcctcttccaaaacagtgcaataaatctccggtaacccgtccacctggccgaggcagcccagagcagcgggatgagctggcggccagagaacgcccagcccagcccacccccgctcacgtcctgccgcacccctccgccggtccccaccctctgccccccagccctctggcgtctctagaaactgctgctgatggagaccaggacagagcccgcccccacccggcccgcagcccctcctgcccctcctgccaggccctccctcccgggtggtggccggcacctctgctcctcacgtgggtcgcggggcgggcttgtcccaggtttgtttgagacagtctttttttattttgtattgttatttttattatttttaatttaaacctgatgacttgcacagcatctttcccaccgggaagagcgggcctgctgccttccctcctgcggggtgggggtgggacagaccccagtgggggccagggccacactcagcgcagtgtgggctggacccgcctctgtgctccaggggctggccggtcttcgggggcgccggcttccaccactcgccgccccacccctgcactccgtgacctctgagaacccagctggcccctcgttagccccagggtctgccgtctagagggagcccaccggcctccggacactgtcttcccgctagagccccgtcctcctctgcggggctctccggacccccttccccctcacctccaggcagggacagaataaatgtttgtatggatttta

SEQ ID NO: 355519 - DNA, 4755 bp, Homo sapiens
ggagcaagatggcggcggcggggtccgtgaggcgcgggcggcggcgaccgcggcgccagtgagggggccctggggcccgggcggctccgggccggggccccgccgcgggacggaccatgctacgctccactggcttcttccgggccattgactgcccctattggtctggggcgcccggggggccctgccggcggccctactgccacttccggcaccgcggggcccggggccccggcgcgcccggtgacggcggagaggcgccccccgcagcagggctgggttacgacccctacaaccctgagctgcccaagccccccgcgcagagggagaatggcaccctgggcctgggggaggagccgcgcccggatgtgctggagttggagctggtcaaccaggccatcgaggccgtgcgcagtgaggtggagctggagcagcggcgctaccgggagctgctggagacgacccgtgagcaccgctccgccgaggcccccgccctggcgccccgcggccccaacgccagccccactgtgggcccggacgaggatgccttcccactggccttcgactacagccccggcagccacggcctattaagccctgatgccggctaccagcccaccccactggccgcccctgccgagccgggcagcaagtactcgctggcgtccctggacaggggtcagggcagaggtggagggggtggcggtgccctggaatacgtccccaaggctgtgagccagccccggcggcacagccgccccgttcccagtggcaagtacgtggtggacaactccaggccacccacagacctggagtatgaccctctctccaactactcggcccggcacctcagcagggccagctcccgggatgagcgggccgccaagcggccccggggctcccgcggcagtgagccctacacacctgctcccaagaagctctgtgacccctttggcagttgcgatgcaaggttctcagactcagaagatgaggccgccacggtcccaggtaacgagcccaccacggccagcacccccaaagccagggccgaccctgagatcaaggccaccgggcagccaccctccaaagagggcctggaggccgaggggggcggcctgcgggagaccaaggagacggccgtgcagtgcgacgtgggggacctccagccgcccccagccaagcccgcctccccagcccaggtccagtcctcacaggatgggggctgccccaaggagggaaaacccaagaagaaaaaaaccggggccccacctgcccccagctgcaaagacggggcccaggggaaggacaagaccaaggacaagggccgagggcggcctgtggagaagccccgtgcggacaagaagggcccgcaggccagcagcccccggcgcaaggcagagcggccggaagggaccaagaagaagccatcttcggccactcctgtggccacctcagggaaagggaggcctgaccggccagcgcggcggccgagccccacaagcggggactcccgaccggcggccggcagaggcccaccccgccccctccagctgcccgacaggaagagcaccaaggccccgtcggggaagctagtggagcggaaagcccgctcactagacgagggcgcctcccaggacgcccccaagctgaagaagcgggccctgagccacgccgacctctttggggacgagagtgaggacgaggccgcagggccaggggtgccgagcgtgtggccctctgccctccccagcctcagctcggactcagactccgactcagactccagcctgggcttcccggaggcgcaggggccgcccaagcggctcaaggcctccccgcccccctcccccgccccatcctcctcctcctcctcctcctcctccacctccagcgcgggggcggatgtggactactcggccctggagaaggaggtggactttgactccgaccccatggaggagtgcctgcggatcttcaacgagtccaccagcgtcaagacggaggacagaggccggctggcccggcagccccccaaggaagagaagagtgaggagaaggggctttcgggtctgaccactctgttccccgggcagaagaggaggatctcccacctttccaagcaaggccaggaggtggagcccccgaggaggggtcccgcggtgcccccggcccggcccccgacggcgcaggaggtgtgctacctgcgggcccagcaggcgcagagggcatcggcgagcttgctgcaggcccccgccaggctggcagagaagtcgccctccgtccacatttccgcccctggcgagaagaggaggatcgcccacatccccaacccccgcctggctgcagcccccacaggtgccaagaggacccttgcggccagcggcagccagtcctccaacggccctgagccaggtggccagcagctgaaaacacgcacattgtcggggatggcgtccaagactaccaccaccatcatccctaagcgaatcgcccacagtccatccttacagagtttaaagaaacccattatccccaaagagtttgggggcaaagtccccaccgtcatccgccagcgctatctcaacctgttcatcgaggagtgtctcaagttctgtacctccaaccaggaggccatagagaaggcactgaacgaggagaaggtggcctatgaccgcagccccagcaagaacatctacctgaatgtggccgtgaacaccctcaagaagctcaggggcctggcccccagcgctgtgcccggcctcagcaaaaccagtggccgcagggttgtgtcccacgaggtggtgttggggggcaggttggccgccaagaccagcttctcgctcagccgtccaagcagcccccgggtggaggacctgaaaggggctgccctgtacagccgcctcagggagtacctgctcacccaggaccagctcaaggagaacggctaccccttcccgcacccagagcggcccgggggcgcaatcatcttcacagctgaggagaagaggcccaaggactcttcctgcaggacctgctgccgctgtggcaccgagtacctcgtgtcctcttcaggccgctgcatccgggacgaggagtgttattaccactggggacggctgcgccggaaccgggtggccggaggctgggagacccagtacatgtgctgctcggctgccgccggctctgtcggctgccaagtcgcaaagcaacacgtgcaggatggccggaaggagcgccttgagggcttcgtgaagacctttgagaaagagctctcaggagacacccacccggggatctacgccctggactgcgagatgtcctacaccacatatggcctggagctgacgcgcgtcacggtggtcgacacggacgtgcacgtggtttatgacaccttcgtgaagcctgacaacgagatcgtggactacaacaccaggttttcgggggtgacggaggctgaccttgccgacacaagtgtcacgctgcgtgacgtccaggccgttctgctgagcatgttcagcgctgacaccatcctcatcggacacagcctggagagcgacctcctggccctgaaggtgccctgccggcccgggtcccgcgcggttctccagcaggacctgcgcaggccccacgtgcgctgatctctgccgctgcccacaggtcatccacagcaccgtggtggacacgtctgtgctcttcccccaccgcctgggcctcccctacaagcggtccctgcggaacctcatggccgactacctcagacagatcatccaggacaatggtgagtgccggtgcctgccctggggccgtccctgcgcaggggccgggtgctcaccgcatctgccccgcagtggatgggcacagctccagcgaggacgccggcgcctgcatgcacctggtgatctggaaggttcgagaagacgccaagaccaagcgatgacgcctgcccgcctcccacccgcctctcctgccgtcccgctggtccttagccccatgcctcttccaaaacagtgcaataaatctccggtaacccgtccacctggccgaggcagcccagagcagcgggatgagctggcggccagagaacgcccagcccagcccacccccgctcacgtcctgccgcacccctccgccggtccccaccctctgccccccagccctctggcgtctctagaaactgctgctgatggagaccaggacagagcccgcccccacccggcccgcagcccctcctgcccctcctgccaggccctccctcccgggtggtggccggcacctctgctcctcacgtgggtcgcggggcgggcttgtcccaggtttgtttgagacagtctttttttattttgtattgttatttttattatttttaatttaaacctgatgacttgcacagcatctttcccaccgggaagagcgggcctgctgccttccctcctgcggggtgggggtgggacagaccccagtgggggccagggccacactcagcgcagtgtgggctggacccgcctctgtgctccaggggctggccggtcttcgggggcgccggcttccaccactcgccgccccacccctgcactccgtgacctctgagaacccagctggcccctcgttagccccagggtctgccgtctagagggagcccaccggcctccggacactgtcttcccgctagagccccgtcctcctctgcggggctctccggacccccttccccctcacctccaggcagggacagaataaatgtttgtatggatttta

SEQ ID NO: 355520 - DNA, 4685 bp, Homo sapiens
ggagcaagatggcggcggcggggtccgtgaggcgcgggcggcggcgaccgcggcgccagtgagggggccctggggcccgggcggctccgggccggggccccgccgcgggacggaccatgctacgctccactggcttcttccgggccattgactgcccctattggtctggggcgcccggggggccctgccggcggccctactgccacttccggcaccgcggggcccggggccccggcgcgcccggtgacggcggagaggcgccccccgcagcagggctgggttacgacccctacaaccctgagctgcccaagccccccgcgcagagggagaatggcaccctgggcctgggggaggagccgcgcccggatgtgctggagttggagctggtcaaccaggccatcgaggccgtgcgcagtgaggtggagctggagcagcggcgctaccgggagctgctggagacgacccgtgagcaccgctccgccgaggcccccgccctggcgccccgcggccccaacgccagccccactgtgggcccggacgaggatgccttcccactggccttcgactacagccccggcagccacggcctattaagccctgatgccggctaccagcccaccccactggccgcccctgccgagccgggcagcaagtactcgctggcgtccctggacaggggtcagggcagaggtggagggggtggcggtgccctggaatacgtccccaaggctgtgagccagccccggcggcacagccgccccgttcccagtggcaagtacgtggtggacaactccaggccacccacagacctggagtatgaccctctctccaactactcggcccggcacctcagcagggccagctcccgggatgagcgggccgccaagcggccccggggctcccgcggcagtgagccctacacacctgctcccaagaagctctgtgacccctttggcagttgcgatgcaaggttctcagactcagaagatgaggccgccacggtcccaggtaacgagcccaccacggccagcacccccaaagccagggccgaccctgagatcaaggccaccgggcagccaccctccaaagagggcctggaggccgaggggggcggcctgcgggagaccaaggagacggccgtgcagtgcgacgtgggggacctccagccgcccccagccaagcccgcctccccagcccaggtccagtcctcacaggatgggggctgccccaaggagggaaaacccaagaagaaaaaaaccggggccccacctgcccccagctgcaaagacggggcccaggggaaggacaagaccaaggacaagggccgagggcggcctgtggagaagccccgtgcggacaagaagggcccgcaggccagcagcccccggcgcaaggcagagcggccggaagggaccaagaagaagccatcttcggccactcctgtggccacctcagggaaagggaggcctgaccggccagcgcggcggccgagccccacaagcggggactcccgaccggcggccggcagaggcccaccccgccccctccagctgcccgacaggaagagcaccaaggccccgtcggggaagctagtggagcggaaagcccgctcactagacgagggcgcctcccaggacgcccccaagctgaagaagcgggccctgagccacgccgacctctttggggacgagagtgaggacgaggccgcagggccaggggtgccgagcgtgtggccctctgccctccccagcctcagctcggactcagactccgactcagactccagcctgggcttcccggaggcgcaggggccgcccaagcggctcaaggcctccccgcccccctcccccgccccatcctcctcctcctcctcctcctcctccacctccagcgcgggggcggatgtggactactcggccctggagaaggaggtggactttgactccgaccccatggaggagtgcctgcggatcttcaacgagtccaccagcgtcaagacggaggacagaggccggctggcccggcagccccccaaggaagagaagagtgaggagaaggggctttcgggtctgaccactctgttccccgggcagaagaggaggatctcccacctttccaagcaaggccaggaggtggagcccccgaggaggggtcccgcggtgcccccggcccggcccccgacggcgcaggaggtgtgctacctgcgggcccagcaggcgcagagggcatcggcgagcttgctgcaggcccccgccaggctggcagagaagtcgccctccgtccacatttccgcccctggcgagaagaggaggatcgcccacatccccaacccccgcctggctgcagcccccacaggtgccaagaggacccttgcggccagcggcagccagtcctccaacggccctgagccaggtggccagcagctgaaaacacgcacattgtcggggatggcgtccaagactaccaccaccatcatccctaagcgaatcgcccacagtccatccttacagagtttaaagaaacccattatccccaaagagtttgggggcaaagtccccaccgtcatccgccagcgctatctcaacctgttcatcgaggagtgtctcaagttctgtacctccaaccaggaggccatagagaaggcactgaacgaggagaaggtggcctatgaccgcagccccagcaagaacatctacctgaatgtggccgtgaacaccctcaagaagctcaggggcctggcccccagcgctgtgcccggcctcagcaaaaccagtggccgcagggttgtgtcccacgaggtggtgttggggggcaggttggccgccaagaccagcttctcgctcagccgtccaagcagcccccgggtggaggacctgaaaggggctgccctgtacagccgcctcagggagtacctgctcacccaggaccagctcaaggagaacggctaccccttcccgcacccagagcggcccgggggcgcaatcatcttcacagctgaggagaagaggcccaaggactcttcctgcaggacctgctgccgctgtggcaccgagtacctcgtgtcctcttcaggccgctgcatccgggacgaggagtgttattaccactggggacggctgcgccggaaccgggtggccggaggctgggagacccagtacatgtgctgctcggctgccgccggctctgtcggctgccaagtcgcaaagcaacacgtgcaggatggccggaaggagcgccttgagggcttcgtgaagacctttgagaaagagctctcaggagacacccacccggggatctacgccctggactgcgagatgtcctacaccacatatggcctggagctgacgcgcgtcacggtggtcgacacggacgtgcacgtggtttatgacaccttcgtgaagcctgacaacgagatcgtggactacaacaccaggttttcgggggtgacggaggctgaccttgccgacacaagtgtcacgctgcgtgacgtccaggccgttctgctgagcatgttcagcgctgacaccatcctcatcggacacagcctggagagcgacctcctggccctgaaggtgccctgccggcccgggtcccgcgcggttctccagcaggacctgcgcaggccccacgtgcgctgatctctgccgctgcccacaggtcatccacagcaccgtggtggacacgtctgtgctcttcccccaccgcctgggcctcccctacaagcggtccctgcggaacctcatggccgactacctcagacagatcatccaggacaatgtggatgggcacagctccagcgaggacgccggcgcctgcatgcacctggtgatctggaaggttcgagaagacgccaagaccaagcgatgacgcctgcccgcctcccacccgcctctcctgccgtcccgctggtccttagccccatgcctcttccaaaacagtgcaataaatctccggtaacccgtccacctggccgaggcagcccagagcagcgggatgagctggcggccagagaacgcccagcccagcccacccccgctcacgtcctgccgcacccctccgccggtccccaccctctgccccccagccctctggcgtctctagaaactgctgctgatggagaccaggacagagcccgcccccacccggcccgcagcccctcctgcccctcctgccaggccctccctcccgggtggtggccggcacctctgctcctcacgtgggtcgcggggcgggcttgtcccaggtttgtttgagacagtctttttttattttgtattgttatttttattatttttaatttaaacctgatgacttgcacagcatctttcccaccgggaagagcgggcctgctgccttccctcctgcggggtgggggtgggacagaccccagtgggggccagggccacactcagcgcagtgtgggctggacccgcctctgtgctccaggggctggccggtcttcgggggcgccggcttccaccactcgccgccccacccctgcactccgtgacctctgagaacccagctggcccctcgttagccccagggtctgccgtctagagggagcccaccggcctccggacactgtcttcccgctagagccccgtcctcctctgcggggctctccggacccccttccccctcacctccaggcagggacagaataaatgtttgtatggatttta

SEQ ID NO: 355521 - DNA, 4003 bp, Homo sapiens
ggagcaagatggcggcggcggggtccgtgaggcgcgggcggcggcgaccgcggcgccagtgagggggccctggggcccgggcggctccgggccggggccccgccgcgggacggaccatgctacgctccactggcttcttccgggccattgactgcccctattggtctggggcgcccggggggccctgccggcggccctactgccacttccggcaccgcggggcccggggccccggcgcgcccggtgacggcggagaggcgccccccgcagcagggctgggttacgacccctacaaccctgagctgcccaagccccccgcgcagagggagaatggcaccctgggcctgggggaggagccgcgcccggatgtgctggagttggagctggtcaaccaggccatcgaggccgtgcgcagtgaggtggagctggagcagcggcgctaccgggagctgctggagacgacccgtgagcaccgctccgccgaggcccccgccctggcgccccgcggccccaacgccagccccactgtgggcccggacgaggatgccttcccactggccttcgactacagccccggcagccacggcctattaagccctgatgccggctaccagcccaccccactggccgcccctgccgagccgggcagcaagtactcgctggcgtccctggacaggggtcagggcagaggtggagggggtggcggtgccctggaatacgtccccaaggctgtgagccagccccggcggcacagccgccccgttcccagtggcaagtacgtggtggacaactccaggccacccacagacctggagtatgaccctctctccaactactcggcccggcacctcagcagggccagctcccgggatgagcgggccgccaagcggccccggggctcccgcggcagtgagccctacacacctgctcccaagaagctctgtgacccctttggcagttgcgatgcaaggttctcagactcagaagatgaggccgccacggtcccaggtaacgagcccaccacggccagcacccccaaagccagggccgaccctgagatcaaggccaccgggcagccaccctccaaagagggcctggaggccgaggggggcggcctgcgggagaccaaggagacggccgtgcagtgcgacgtgggggacctccagccgcccccagccaagcccgcctccccagcccaggtccagtcctcacaggatgggggctgccccaaggagggaaaacccaagaagaaaaaaaccggggccccacctgcccccagctgcaaagacggggcccaggggaaggacaagaccaaggacaagggccgagggcggcctgtggagaagccccgtgcggacaagaagggcccgcaggccagcagcccccggcgcaaggcagagcggccggaagggaccaagaagaagccatcttcggccactcctgtggccacctcagggaaagggaggcctgaccggccagcgcggcggccgagccccacaagcggggactcccgaccggcggccggcagaggcccaccccgccccctccagctgcccgacaggaagagcaccaaggccccgtcggggaagctagtggagcggaaagcccgctcactagacgagggcgcctcccaggacgcccccaagctgaagaagcgggccctgagccacgccgacctctttggggacgagagtgaggacgaggccgcagggccaggggtgccgagcgtgtggccctctgccctccccagcctcagctcggactcagactccgactcagactccagcctgggcttcccggaggcgcaggggccgcccaagcggctcaaggcctccccgcccccctcccccgccccatcctcctcctcctcctcctcctcctccacctccagcgcgggggcggatgtggactactcggccctggagaaggaggtggactttgactccgaccccatggaggagtgcctgcggatcttcaacgagtccaccagcgtcaagacggaggacagaggccggctggcccggcagccccccaaggaagagaagagtgaggagaaggggctttcgggtctgaccactctgttccccgggcagaagaggaggatctcccacctttccaagcaaggccaggaggtggagcccccgaggaggggtcccgcggtgcccccggcccggcccccgacggcgcaggaggtgtgctacctgcgggcccagcaggcgcagagggcatcggcgagcttgctgcaggcccccgccaggctggcagagaagtcgccctccgtccacatttccgcccctggcgagaagaggaggatcgcccacatccccaacccccgcctggctgcagcccccacaggtgccaagaggacccttgcggccagcggcagccagtcctccaacggccctgagccaggtggccagcagctgaaaacacgcacattgtcggggatggcgtccaagactaccaccaccatcatccctaagcgaatcgcccacagtccatccttacagagtttaaagaaacccattatccccaaagagtttgggggcaaagtccccaccgtcatccgccagcgctatctcaacctgttcatcgaggagtgtctcaagttctgtacctccaaccaggaggccatagagaaggcactgaacgaggagaaggtggcctatgaccgcagccccagcaagaacatctacctgaatgtggccgtgaacaccctcaagaagctcaggggcctggcccccagcgctgtgcccggcctcagcaaaaccagtggccgcagggttgtgtcccacgaggtggtgttggggggcaggttggccgccaagaccagcttctcgctcagccgtccaagcagcccccgggtggaggacctgaaaggggctgccctgtacagccgcctcagggagtacctgctcacccaggaccagctcaaggagaacggctaccccttcccgcacccagagcggcccgggggcgcaatcatcttcacagctgaggagaagaggcccaaggactcttcctgcaggacctgctgccgctgtggcaccgagtacctcgtgtcctcttcaggccgctgcatccgggacgaggagtgttattaccactggggacggctgcgccggaaccgggtggccggaggctgggagacccagtacatgtgctgctcggctgccgccggctctgtcggctgccaagtcgcaaagcaacacgtgcaggatggccggaaggagcgccttgagggcttcgtgaagacctttgagaaagagctctcaggagacacccacccggggatctacgccctggactgcgagatgtcctacaccacatatggcctggagctgacgcgcgtcacggtggtcgacacggacgtgcacgtggtttatgacaccttcgtgaagcctgacaacgagatcgtggactacaacaccaggttttcgggggtgacggaggctgaccttgccgacacaagtgtcacgctgcgtgacgtccaggccgttctgctgagcatgttcagcgctgacaccatcctcatcggacacagcctggagagcgacctcctggccctgaaggtcatccacagcaccgtggtggacacgtctgtgctcttcccccaccgcctgggcctcccctacaagcggtccctgcggaacctcatggccgactacctcagacagatcatccaggacaatgtggatgggcacagctccagcgaggacgccggcgcctgcatgcacctggtgatctggaaggttcgagaagacgccaagaccaagcgatgacgcctgcccgcctcccacccgcctctcctgccgtcccgctggtccttagccccatgcctcttccaaaacagtgcaataaatctccggtaacccgtccacctggccgaggcagcccagagcagcgggatgagctggcggccagagaacgagtcagcgggagagtctgggggggggagcgaagcgggccgcacggagcggaaaggacccacggacaaccggac

SEQ ID NO: 355522 - DNA, 3357 bp, Homo sapiens
ggagcaagatggcggcggcggggtccgtgaggcgcgggcggcggcgaccgcggcgccagtgagggggccctggggcccgggcggctccgggccggggccccgccgcgggacggaccatgctacgctccactggcttcttccgggccattgactgcccctattggtctggggcgcccggggggccctgccggcggccctactgccacttccggcaccgcggggcccggggccccggcgcgcccggtgacggcggagaggcgccccccgcagcagggctgggttacgacccctacaaccctgagctgcccaagccccccgcgcagagggagaatggcaccctgggcctgggggaggagccgcgcccggatgtgctggagttggagctggtcaaccaggccatcgaggccgtgcgcagtgaggtggagctggagcagcggcgctaccgggagctgctggagacgacccgtgagcaccgctccgccgaggcccccgccctggcgccccgcggccccaacgccagccccactgtgggcccggacgaggatgccttcccactggccttcgactacagccccggcagccacggcctattaagccctgatgccggctaccagcccaccccactggccgcccctgccgagccgggcagcaagtactcgctggcgtccctggacaggggtcagggcagaggtggagggggtggcggtgccctggaatacgtccccaaggctgtgagccagccccggcggcacagccgccccgttcccagtggcaagtacgtggtggacaactccaggccacccacagacctggagtatgaccctctctccaactactcggcccggcacctcagcagggccagctcccgggatgagcgggccgccaagcggccccggggctcccgcggcagtgagccctacacacctgctcccaagaagctctgtgacccctttggcagttgcgatgcaaggttctcagactcagaagatgaggccgccacggtcccaggtaacgagcccaccacggccagcacccccaaagccagggccgaccctgagatcaaggccaccgggcagccaccctccaaagagggcctggaggccgaggggggcggcctgcgggagaccaaggagacggccgtgcagtgcgacgtgggggacctccagccgcccccagccaagcccgcctccccagcccaggtccagtcctcacaggatgggggctgccccaaggagggaaaacccaagaagaaaaaaaccggggccccacctgcccccagctgcaaagacggggcccaggggaaggacaagaccaaggacaagggccgagggcggcctgtggagaagccccgtgcggacaagaagggcccgcaggccagcagcccccggcgcaaggcagagcggccggaagggaccaagaagaagccatcttcggccactcctgtggccacctcagggaaagggaggcctgaccggccagcgcggcggccgagccccacaagcggggactcccgaccggcggccggcagaggcccaccccgccccctccagctgcccgacaggaagagcaccaaggccccgtcggggaagctagtggagcggaaagcccgctcactagacgagggcgcctcccaggacgcccccaagctgaagaagcgggccctgagccacgccgacctctttggggacgagagtgaggacgaggccgcagggccaggggtgccgagcgtgtggccctctgccctccccagcctcagctcggactcagactccgactcagactccagcctgggcttcccggaggcgcaggggccgcccaagcggctcaaggcctccccgcccccctcccccgccccatcctcctcctcctcctcctcctcctccacctccagcgcgggggcggatgtggactactcggccctggagaaggaggtggactttgactccgaccccatggaggagtgcctgcggatcttcaacgagtccaccagcgtcaagacggaggacagaggccggctggcccggcagccccccaaggaagagaagagtgaggagaaggggctttcgggtctgaccactctgttccccgggcagaagaggaggatctcccacctttccaagcaaggccaggaggtggagcccccgaggaggggtcccgcggtgcccccggcccggcccccgacggcgcaggaggtgtgctacctgcgggcccagcaggcgcagagggcatcggcgagcttgctgcaggcccccgccaggctggcagagaagtcgccctccgtccacatttccgcccctggcgagaagaggaggatcgcccacatccccaacccccgcctggctgcagcccccacaggtgccaagaggacccttgcggccagcggcagccagtcctccaacggccctgagccaggtggccagcagctgaaaacacgcacattgtcggggatggcgtccaagactaccaccaccatcatccctaagcgaatcgcccacagtccatccttacagagtttaaagaaacccattatccccaaagagtttgggggcaaagtccccaccgtcatccgccagcgctatctcaacctgttcatcgaggagtgtctcaagttctgtacctccaaccaggaggccatagagaaggcactgaacgaggagaaggtggcctatgaccgcagccccagcaagaacatctacctgaatgtggccgtgaacaccctcaagaagctcaggggcctggcccccagcgctgtgcccggcctcagcaaaaccagtggccgcagggttgtgtcccacgaggtggtgttggggggcaggttggccgccaagaccagcttctcgctcagccgtccaagcagcccccgggtggaggacctgaaaggggctgccctgtacagccgcctcagggagtacctgctcacccaggaccagctcaaggagaacggctaccccttcccgcacccagagcggcccgggggcgcaatcatcttcacagctgaggagaagaggcccaaggactcttcctgcaggacctgctgccgctgtggcaccgagtacctcgtgtcctcttcaggccgctgcatccgggacgaggagtgttattaccactggggacggctgcgccggaaccgggtggccggaggctgggagacccagtacatgtgctgctcggctgccgccggctctgtcggctgccaagtcgcaaagcaacacgtgcaggatggccggaaggagcgccttgagggcttcgtgaagacctttgagaaagagctctcaggagacacccacccggggatctacgccctggactgcgagatggtgaggctgttctctgcccagcgtcgggttcaggattggg

SEQ ID NO: 355523 - DNA, 464 bp, Homo sapiens
gcggccgcggctgcctggtgctccgccacgtggtgatgggcagccactcgccctgtgcccacaccccctgtgccccgccagcccccacaggtgccaagaggacccttgcggccagcggcagccagtcctccaacggccctgagccaggtggccagcagctgaaaacacgcacattgtcggggatggcgtccaagactaccaccaccatcatccctaagcgaatcgcccacagtccatccttacaggtagcccctcccatctcggccaggaccaccacccccaagaccacgccctgaggcccggccacatgggacctgcggagggccagcctcgcccctgccctgcgggccttcgtgctccacaccgcagtacagccttcaccttccctccccatgccttggtgttttttttttttttttgagatggagtctcgctctgtcgcccaggctggagtgcagtggcac

SEQ ID NO: 355524 - DNA, 4600 bp, Homo sapiens
ggagcaagatggcggcggcggggtccgtgaggcgcgggcggcggcgaccgcggcgccagtgagggggccctggggcccgggcggctccgggccggggccccgccgcgggacggaccatgctacgctccactggcttcttccgggccattgactgcccctattggtctggggcgcccggggggccctgccggcggccctactgccacttccggcaccgcggggcccggggccccggcgcgcccggtgacggcggagaggcgccccccgcagcagggctgggttacgacccctacaaccctgagctgcccaagccccccgcgcagagggagaatggcaccctgggcctgggggaggagccgcgcccggatgtgctggagttggagctggtcaaccaggccatcgaggccgtgcgcagtgaggtggagctggagcagcggcgctaccgggagctgctggagacgacccgtgagcaccgctccgccgaggcccccgccctggcgccccgcggccccaacgccagccccactgtgggcccggacgaggatgccttcccactggccttcgactacagccccggcagccacggcctattaagccctgatgccggctaccagcccaccccactggccgcccctgccgagccgggcagcaagtactcgctggcgtccctggacaggggtcagggcagaggtggagggggtggcggtgccctggaatacgtccccaaggctgtgagccagccccggcggcacagccgccccgttcccagtggcaagtacgtggtggacaactccaggccacccacagacctggagtatgaccctctctccaactactcggcccggcacctcagcagggccagctcccgggatgagcgggccgccaagcggccccggggctcccgcggcagtgagccctacacacctgctcccaagaagctctgtgacccctttggcagttgcgatgcaaggttctcagactcagaagatgaggccgccacggtcccaggtaacgagcccaccacggccagcacccccaaagccagggccgaccctgagatcaaggccaccgggcagccaccctccaaagagggcctggaggccgaggggggcggcctgcgggagaccaaggagacggccgtgcagtgcgacgtgggggacctccagccgcccccagccaagcccgcctccccagcccaggtccagtcctcacaggatgggggctgccccaaggagggaaaacccaagaagaaaaaaaccggggccccacctgcccccagctgcaaagacggggcccaggggaaggacaagaccaaggacaagggccgagggcggcctgtggagaagccccgtgcggacaagaagggcccgcaggccagcagcccccggcgcaaggcagagcggccggaagggaccaagaagaagccatcttcggccactcctgtggccacctcagggaaagggaggcctgaccggccagcgcggcggccgagccccacaagcggggactcccgaccggcggccggcagaggcccaccccgccccctccagctgcccgacaggaagagcaccaaggccccgtcggggaagctagtggagcggaaagcccgctcactagacgagggcgcctcccaggacgcccccaagctgaagaagcgggccctgagccacgccgacctctttggggacgagagtgaggacgaggccgcagggccaggggtgccgagcgtgtggccctctgccctccccagcctcagctcggactcagactccgactcagactccagcctgggcttcccggaggcgcaggggccgcccaagcggctcaaggcctccccgcccccctcccccgccccatcctcctcctcctcctcctcctcctccacctccagcgcgggggcggatgtggactactcggccctggagaaggaggtggactttgactccgaccccatggaggagtgcctgcggatcttcaacgagtccaccagcgtcaagacggaggacagaggccggctggcccggcagccccccaaggaagagaagagtgaggagaaggggctttcgggtctgaccactctgttccccgggcagaagaggaggatctcccacctttccaagcaaggccaggaggtggagcccccgaggaggggtcccgcggtgcccccggcccggcccccgacggcgcaggaggtgtgctacctgcgggcccagcaggcgcagagggcatcggcgagcttgctgcaggcccccgccaggctggcagagaagtcgccctccgtccacatttccgcccctggcgagaagaggaggatcgcccacatccccaacccccgcctggctgcagcccccacaggtgccaagaggacccttgcggccagcggcagccagtcctccaacggccctgagccaggtggccagcagctgaaaacacgcacattgtcggggatggcgtccaagactaccaccaccatcatccctaagcgaatcgcccacagtccatccttacagagtttaaagaaacccattatccccaaagagtttgggggcaaagtccccaccgtcatccgccagcgctatctcaacctgttcatcgaggagtgtctcaagttctgtacctccaaccaggaggccatagagaaggcactgaacgaggagaaggtggcctatgaccgcagccccagcaagaacatctacctgaatgtggccgtgaacaccctcaagaagctcaggggcctggcccccagcgctgtgcccggcctcagcaaaaccagtggccgcagggttgtgtcccacgaggtggtgttggggggcaggttggccgccaagaccagcttctcgctcagccgtccaagcagcccccgggtggaggacctgaaaggggctgccctgtacagccgcctcagggagtacctgctcacccaggaccagctcaaggagaacggctaccccttcccgcacccagagcggcccgggggcgcaatcatcttcacagctgaggagaagaggcccaaggactcttcctgcaggacctgctgccgctgtggcaccgagtacctcgtgtcctcttcaggccgctgcatccgggacgaggagtgttattaccactggggacggctgcgccggaaccgggtggccggaggctgggagacccagtacatgtgctgctcggctgccgccggctctgtcggctgccaagtcgcaaagcaacacgtgcaggatggccggaaggagcgccttgagggcttcgtgaagacctttgagaaagagctctcaggagacacccacccggggatctacgccctggactgcgagatgtcctacaccacatatggcctggagctgacgcgcgtcacggtggtcgacacggacgtgcacgtggtttatgacaccttcgtgaagcctgacaacgagatcgtggactacaacaccaggttttcgggggtgacggaggctgaccttgccgacacaagtgtcacgctgcgtgacgtccaggccgttctgctgagcatgttcagcgctgacaccatcctcatcggacacagcctggagagcgacctcctggccctgaaggtcatccacagcaccgtggtggacacgtctgtgctcttcccccaccgcctgggcctcccctacaagcggtccctgcggaacctcatggccgactacctcagacagatcatccaggacaatgtggatgggcacagctccagcgaggacgccggcgcctgcatgcacctggtgatctggaaggttcgagaagacgccaagaccaagcgatgacgcctgcccgcctcccacccgcctctcctgccgtcccgctggtccttagccccatgcctcttccaaaacagtgcaataaatctccggtaacccgtccacctggccgaggcagcccagagcagcgggatgagctggcggccagagaacgcccagcccagcccacccccgctcacgtcctgccgcacccctccgccggtccccaccctctgccccccagccctctggcgtctctagaaactgctgctgatggagaccaggacagagcccgcccccacccggcccgcagcccctcctgcccctcctgccaggccctccctcccgggtggtggccggcacctctgctcctcacgtgggtcgcggggcgggcttgtcccaggtttgtttgagacagtctttttttattttgtattgttatttttattatttttaatttaaacctgatgacttgcacagcatctttcccaccgggaagagcgggcctgctgccttccctcctgcggggtgggggtgggacagaccccagtgggggccagggccacactcagcgcagtgtgggctggacccgcctctgtgctccaggggctggccggtcttcgggggcgccggcttccaccactcgccgccccacccctgcactccgtgacctctgagaacccagctggcccctcgttagccccagggtctgccgtctagagggagcccaccggcctccggacactgtcttcccgctagagccccgtcctcctctgcggggctctccggacccccttccccctcacctccaggcagggacagaataaatgtttgtatggatttta

SEQ ID NO: 355525 - DNA, 292 bp, Homo sapiens
  misc_feature (33)..(33): n is a, c, g, or t
ccgtattggtggtgctccggggaggcgtgcgcnctggagggacctccagtcacactgctatggggaagaagaggggcaaggaatgttgcacactctcacctttgaaaagcagctccacaaacccagtgagatcagattccaacaaaggcgcacgggttctgaggattccgagtctgaaggtggtggtgttgaagctgcatgggatggttgcgaaactgctctgcaagatctcggcctgtccatggccccctcagtgacgggcaagggagatttcaccccatctagagcccca

SEQ ID NO: 355526 - DNA, 2408 bp, Homo sapiens
  misc_feature (1)..(3): n is a, c, g, or t
  misc_feature (6)..(6): n is a, c, g, or t
nnnttnttttgtttttaattaatagactttatgttttttgagcaactttaggtttctaggaaaattgagcagaaagtacagcaagttcccttgtgcccccatggcctcagtttcccatgaccttagttccgctgccctcagtttcccctgctgctcctgtcttgccttggcgtgtctgtccctactgcagccaggctgatctgtcccagcgcacctcactcttgcctccagccatgggcacggcctcatcgcgtctgcgttccccgctggaggccttgtggaggccctcacccatggcagcttttgccttccctctagagtttaaagaaacccattatccccaaagagtttgggggcaaagtccccaccgtcatccgccagcgctatctcaacctgttcatcgaggagtgtctcaagttctgtacctccaaccaggaggccatagagaaggcactgaacgaggagaaggtggcctatgaccgcagccccagcaagaacatctacctgaatgtggccgtgaacaccctcaagaagctcaggggcctggcccccagcgctgtgcccggcctcagcaaaaccagtggccgcagggttgtgtcccacgaggtggtgttggggggcaggttggccgccaagaccagcttctcgctcagccgtccaagcagcccccgggtggaggacctgaaaggggctgccctgtacagccgcctcagggagtacctgctcacccaggaccagctcaaggagaacggctaccccttcccgcacccagagcggcccgggggcgcaatcatcttcacagctgaggagaagaggcccaaggactcttcctgcaggacctgctgccgctgtggcaccgagtacctcgtgtcctcttcaggccgctgcatccgggacgaggagtgttattaccactggggacggctgcgccggaaccgggtggccggaggctgggagacccagtacatgtgctgctcggctgccgccggctctgtcggctgccaagtcgcaaagcaacacgtgcaggatggccggaaggagcgccttgagggcttcgtgaagacctttgagaaagagctctcaggagacacccacccggggatctacgccctggactgcgagatgtcctacaccacatatggcctggagctgacgcgcgtcacggtggtcgacacggacgtgcacgtggtttatgacaccttcgtgaagcctgacaacgagatcgtggactacaacaccaggttttcgggggtgacggaggctgaccttgccgacacaagtgtcacgctgcgtgacgtccaggccgttctgctgagcatgttcagcgctgacaccatcctcatcggacacagcctggagagcgacctcctggccctgaaggtcatccacagcaccgtggtggacacgtctgtgctcttcccccaccgcctgggcctcccctacaagcggtccctgcggaacctcatggccgactacctcagacagatcatccaggacaatgtggatgggcacagctccagcgaggacgccggcgcctgcatgcacctggtgatctggaaggttcgagaagacgccaagaccaagcgatgacgcctgcccgcctcccacccgcctctcctgccgtcccgctggtccttagccccatgcctcttccaaaacagtgcaataaatctccggtaacccgtccacctggccgaggcagcccagagcagcgggatgagctggcggccagagaacgcccagcccagcccacccccgctcacgtcctgccgcacccctccgccggtccccaccctctgccccccagccctctggcgtctctagaaactgctgctgatggagaccaggacagagcccgcccccacccggcccgcagcccctcctgcccctcctgccaggccctccctcccgggtggtggccggcacctctgctcctcacgtgggtcgcggggcgggcttgtcccaggtttgtttgagacagtctttttttattttgtattgttatttttattatttttaatttaaacctgatgacttgcacagcatctttcccaccgggaagagcgggcctgctgccttccctcctgcggggtgggggtgggacagaccccagtgggggccagggccacactcagcgcagtgtgggctggacccgcctctgtgctccaggggctggccggtcttcgggggcgccggcttccaccactcgccgccccacccctgcactccgtgacctctgagaacccagctggcccctcgttagccccagggtctgccgtctagagggagcccaccggcctccggacactgtcttcccgctagagccccgtcctcctctgcggggctctccggacccccttccccctcacctccaggcagggacagaataaatgtttgtatggatttta

SEQ ID NO: 355527 - DNA, 4621 bp, Homo sapiens
ggagcaagatggcggcggcggggtccgtgaggcgcgggcggcggcgaccgcggcgccagtgagggggccctggggcccgggcggctccgggccggggccccgccgcgggacggaccatgctacgctccactggcttcttccgggccattgactgcccctattggtctggggcgcccggggggccctgccggcggccctactgccacttccggcaccgcggggcccggggccccggcgcgcccggtgacggcggagaggcgccccccgcagcagggctgggttacgacccctacaaccctgagctgcccaagccccccgcgcagagggagaatggcaccctgggcctgggggaggagccgcgcccggatgtgctggagttggagctggtcaaccaggccatcgaggccgtgcgcagtgaggtggagctggagcagcggcgctaccgggagctgctggagacgacccgtgagcaccgctccgccgaggcccccgccctggcgccccgcggccccaacgccagccccactgtgggcccggacgaggatgccttcccactggccttcgactacagccccggcagccacggcctattaagccctgatgccggctaccagcccaccccactggccgcccctgccgagccgggcagcaagtactcgctggcgtccctggacaggggtcagggcagaggtggagggggtggcggtgccctggaatacgtccccaaggctgtgagccagccccggcggcacagccgccccgttcccagtggcaagtacgtggtggacaactccaggccacccacagacctggagtatgaccctctctccaactactcggcccggcacctcagcagggccagctcccgggatgagcgggccgccaagcggccccggggctcccgcggcagtgagccctacacacctgctcccaagaagctctgtgacccctttggcagttgcgatgcaaggttctcagactcagaagatgaggccgccacggtcccaggtaacgagcccaccacggccagcacccccaaagccagggccgaccctgagatcaaggccaccgggcagccaccctccaaagagggcctggaggccgaggggggcggcctgcgggagaccaaggagacggccgtgcagtgcgacgtgggggacctccagccgcccccagccaagcccgcctccccagcccaggtccagtcctcacaggatgggggctgccccaaggagggaaaacccaagaagaaaaaaaccggggccccacctgcccccagctgcaaagacggggcccaggggaaggacaagaccaaggacaagggccgagggcggcctgtggagaagccccgtgcggacaagaagggcccgcaggccagcagcccccggcgcaaggcagagcggccggaagggaccaagaagaagccatcttcggccactcctgtggccacctcagggaaagggaggcctgaccggccagcgcggcggccgagccccacaagcggggactcccgaccggcggccggcagaggcccaccccgccccctccagctgcccgacaggaagagcaccaaggccccgtcggggaagctagtggagcggaaagcccgctcactagacgagggcgcctcccaggacgcccccaagctgaagaagcgggccctgagccacgccgacctctttggggacgagagtgaggacgaggccgcagggccaggggtgccgagcgtgtggccctctgccctccccagcctcagctcggactcagactccgactcagactccagcctgggcttcccggaggcgcaggggccgcccaagcggctcaaggcctccccgcccccctcccccgccccatcctcctcctcctcctcctcctcctccacctccagcgcgggggcggatgtggactactcggccctggagaaggaggtggactttgactccgaccccatggaggagtgcctgcggatcttcaacgagtccaccagcgtcaagacggaggacagaggccggctggcccggcagccccccaaggaagagaagagtgaggagaaggggctttcgggtctgaccactctgttccccgggcagaagaggaggatctcccacctttccaagcaaggccaggaggtggagcccccgaggaggggtcccgcggtgcccccggcccggcccccgacggcgcaggaggtgtgctacctgcgggcccagcaggcgcagagggcatcggcgagcttgctgcaggcccccgccaggctggcagagaagtcgccctccgtccacatttccgcccctggcgagaagaggaggatcgcccacatccccaacccccgcctggctgcagcccccacaggtgccaagaggacccttgcggccagcggcagccagtcctccaacggccctgagccaggtggccagcagctgaaaacacgcacattgtcggggatggcgtccaagactaccaccaccatcatccctaagcgaatcgcccacagtccatccttacagagtttaaagaaacccattatccccaaagagtttgggggcaaagtccccaccgtcatccgccagcgctatctcaacctgttcatcgaggagtgtctcaagttctgtacctccaaccaggaggccatagagaaggcactgaacgaggagaaggtggcctatgaccgcagccccagcaagaacatctacctgaatgtggccgtgaacaccctcaagaagctcaggggcctggcccccagcgctgtgcccggcctcagcaaaaccagtggccgcagggttgtgtcccacgaggtggtgttggggggcaggttggccgccaagaccagcttctcgctcagccgtccaagcagcccccgggtggaggacctgaaaggggctgccctgtacagccgcctcagggagtacctgctcacccaggaccagctcaaggagaacggctaccccttcccgcacccagagcggcccgggggcgcaatcatcttcacagctgaggagaagaggcccaaggactcttcctgcaggacctgctgccgctgtggcaccgagtacctcgtgtcctcttcaggccgctgcatccgggacgaggagtgttattaccactggggacggctgcgccggaaccgggtggccggaggctgggagacccagtacatgtgctgctcggctgccgccggctctgtcggctgccaagtcgcaaagcaacacgtgcaggatggccggaaggagcgccttgagggcttcgtgaagacctttgagaaagagctctcaggagacacccacccggggatctacgccctggactgcgagatgtcctacaccacatatggcctggagctgacgcgcgtcacggtggtcgacacggacgtgcacgtggtttatgacaccttcgtgaagcctgacaacgagatcgtggactacaacaccaggttttcgggggtgacggaggctgaccttgccgacacaagtgtcacgctgcgtgacgtccaggccgttctgctgagcatgttcagcgctgacaccatcctcatcggacacagcctggagagcgacctcctggccctgaaggtcatccacagcaccgtggtggacacgtctgtgctcttcccccaccgcctgggcctcccctacaagcggtccctgcggaacctcatggccgactacctcagacagatcatccaggacaatgtggatgggcacagctccagcgaggacgccggcgcctgcatgcacctggtgatctggaaggttcgagaagacgccaagaccaagcgatgacgcctgcccgcctcccacccgcctctcctgccgtcccgctggtccttagccccatgcctcttccaaaacagtgcaataaatctccggtaacccgtccacctggccgaggcagcccagagcagcgggatgagctggcggccagagaacgcccagcccagcccacccccgctcacgtcctgccgcacccctccgccggtccccaccctctgccccccagccctctggcgtctctagaaactgctgctgatggagaccaggacagagcccgcccccacccggcccgcagcccctcctgcccctcctgccaggccctccctcccgggtggtggccggcacctctgctcctcacgtgggtcgcggggcgggcttgtcccaggtttgtttgagacagtctttttttattttgtattgttatttttattatttttaatttaaacctgatgacttgcacagcatctttcccaccgggaagagcgggcctgctgccttccctcctgcggggtgggggtgggacagaccccagtgggggccagggccacactcagcgcagtgtgggctggacccgcctctgtgctccaggggctggccggtcttcgggggcgccggcttccaccactcgccgccccacccctgcactccgtgacctctgagaacccagctggcccctcgttagccccagggtctgccgtctagagggagcccaccggcctccggacactgtcttcccgctagagccccgtcctcctctgcggggctctccggacccccttccccctcacctccaggcagggacagaataaatgtttgtatggattttaaaaagaaccacaacaacaaac

SEQ ID NO: 355528 - DNA, 2614 bp, Homo sapiens
  misc_feature (1)..(3): n is a, c, g, or t
  misc_feature (6)..(6): n is a, c, g, or t
nnnttnttttgtttttaattaatagactttatgttttttgagcaactttaggtttctaggaaaattgagcagaaagtacagcaagttcccttgtgcccccatggcctcagtttcccatgaccttagttccgctgccctcagtttcccctgctgctcctgtcttgccttggcgtgtctgtccctactgcagccaggctgatctgtcccagcgcacctcactcttgcctccagccatgggcacggcctcatcgcgtctgcgttccccgctggaggccttgtggaggccctcacccatggcagcttttgccttccctctagagtttaaagaaacccattatccccaaagagtttgggggcaaagtccccaccgtcatccgccagcgctatctcaacctgttcatcgaggagtgtctcaagttctgtacctccaaccaggaggccatagagaaggtgaggtcctggagttcctatctggccggtcgggtggggactaggggtccagggtggtccccagacatcccccggcctctcagccgcagctgtgacccggagctgcctgggagagatgcaagtccccgaccccatggcgaccccaccgctggggctccccggcaccaggcaggcatggcctcagctgggcaccgcctgtcccccaggcactgaacgaggagaaggtggcctatgaccgcagccccagcaagaacatctacctgaatgtggccgtgaacaccctcaagaagctcaggggcctggcccccagcgctgtgcccggcctcagcaaaaccagtggccgcagggttgtgtcccacgaggtggtgttggggggcaggttggccgccaagaccagcttctcgctcagccgtccaagcagcccccgggtggaggacctgaaaggggctgccctgtacagccgcctcagggagtacctgctcacccaggaccagctcaaggagaacggctaccccttcccgcacccagagcggcccgggggcgcaatcatcttcacagctgaggagaagaggcccaaggactcttcctgcaggacctgctgccgctgtggcaccgagtacctcgtgtcctcttcaggccgctgcatccgggacgaggagtgttattaccactggggacggctgcgccggaaccgggtggccggaggctgggagacccagtacatgtgctgctcggctgccgccggctctgtcggctgccaagtcgcaaagcaacacgtgcaggatggccggaaggagcgccttgagggcttcgtgaagacctttgagaaagagctctcaggagacacccacccggggatctacgccctggactgcgagatgtcctacaccacatatggcctggagctgacgcgcgtcacggtggtcgacacggacgtgcacgtggtttatgacaccttcgtgaagcctgacaacgagatcgtggactacaacaccaggttttcgggggtgacggaggctgaccttgccgacacaagtgtcacgctgcgtgacgtccaggccgttctgctgagcatgttcagcgctgacaccatcctcatcggacacagcctggagagcgacctcctggccctgaaggtcatccacagcaccgtggtggacacgtctgtgctcttcccccaccgcctgggcctcccctacaagcggtccctgcggaacctcatggccgactacctcagacagatcatccaggacaatgtggatgggcacagctccagcgaggacgccggcgcctgcatgcacctggtgatctggaaggttcgagaagacgccaagaccaagcgatgacgcctgcccgcctcccacccgcctctcctgccgtcccgctggtccttagccccatgcctcttccaaaacagtgcaataaatctccggtaacccgtccacctggccgaggcagcccagagcagcgggatgagctggcggccagagaacgcccagcccagcccacccccgctcacgtcctgccgcacccctccgccggtccccaccctctgccccccagccctctggcgtctctagaaactgctgctgatggagaccaggacagagcccgcccccacccggcccgcagcccctcctgcccctcctgccaggccctccctcccgggtggtggccggcacctctgctcctcacgtgggtcgcggggcgggcttgtcccaggtttgtttgagacagtctttttttattttgtattgttatttttattatttttaatttaaacctgatgacttgcacagcatctttcccaccgggaagagcgggcctgctgccttccctcctgcggggtgggggtgggacagaccccagtgggggccagggccacactcagcgcagtgtgggctggacccgcctctgtgctccaggggctggccggtcttcgggggcgccggcttccaccactcgccgccccacccctgcactccgtgacctctgagaacccagctggcccctcgttagccccagggtctgccgtctagagggagcccaccggcctccggacactgtcttcccgctagagccccgtcctcctctgcggggctctccggacccccttccccctcacctccaggcagggacagaataaatgtttgtatggatttta

SEQ ID NO: 355529 - DNA, 3332 bp, Homo sapiens
ggagcaagatggcggcggcggggtccgtgaggcgcgggcggcggcgaccgcggcgccagtgagggggccctggggcccgggcggctccgggccggggccccgccgcgggacggaccatgctacgctccactggcttcttccgggccattgactgcccctattggtctggggcgcccggggggccctgccggcggccctactgccacttccggcaccgcggggcccggggccccggcgcgcccggtgacggcggagaggcgccccccgcagcagggctgggttacgacccctacaaccctgagctgcccaagccccccgcgcagagggagaatggcaccctgggcctgggggaggagccgcgcccggatgtgctggagttggagctggtcaaccaggccatcgaggccgtgcgcagtgaggtggagctggagcagcggcgctaccgggagctgctggagacgacccgtgagcaccgctccgccgaggcccccgccctggcgccccgcggccccaacgccagccccactgtgggcccggacgaggatgccttcccactggccttcgactacagccccggcagccacggcctattaagccctgatgccggctaccagcccaccccactggccgcccctgccgagccgggcagcaagtactcgctggcgtccctggacaggggtcagggcagaggtggagggggtggcggtgccctggaatacgtccccaaggctgtgagccagccccggcggcacagccgccccgttcccagtggcaagtacgtggtggacaactccaggccacccacagacctggagtatgaccctctctccaactactcggcccggcacctcagcagggccagctcccgggatgagcgggccgccaagcggccccggggctcccgcggcagtgagccctacacacctgctcccaagaagctctgtgacccctttggcagttgcgatgcaaggttctcagactcagaagatgaggccgccacggtcccaggtaacgagcccaccacggccagcacccccaaagccagggccgaccctgagatcaaggccaccgggcagccaccctccaaagagggcctggaggccgaggggggcggcctgcgggagaccaaggagacggccgtgcagtgcgacgtgggggacctccagccgcccccagccaagcccgcctccccagcccaggtccagtcctcacaggatgggggctgccccaaggagggaaaacccaagaagaaaaaaaccggggccccacctgcccccagctgcaaagacggggcccaggggaaggacaagaccaaggacaagggccgagggcggcctgtggagaagccccgtgcggacaagaagggcccgcaggccagcagcccccggcgcaaggcagagcggccggaagggaccaagaagaagccatcttcggccactcctgtggccacctcagggaaagggaggcctgaccggccagcgcggcggccgagccccacaagcggggactcccgaccggcggccggcagaggcccaccccgccccctccagctgcccgacaggaagagcaccaaggccccgtcggggaagctagtggagcggaaagcccgctcactagacgagggcgcctcccaggacgcccccaagctgaagaagcgggccctgagccacgccgacctctttggggacgagagtgaggacgaggccgcagggccaggggtgccgagcgtgtggccctctgccctccccagcctcagctcggactcagactccgactcagactccagcctgggcttcccggaggcgcaggggccgcccaagcggctcaaggcctccccgcccccctcccccgccccatcctcctcctcctcctcctcctcctccacctccagcgcgggggcggatgtggactactcggccctggagaaggaggtggactttgactccgaccccatggaggagtgcctgcggatcttcaacgagtccaccagcgtcaagacggaggacagaggccggctggcccggcagccccccaaggaagagaagagtgaggagaaggggctttcgggtctgaccactctgttccccgggcagaagaggaggatctcccacctttccaagcaaggccaggaggtggagcccccgaggaggggtcccgcggtgcccccggcccggcccccgacggcgcaggaggtgtgctacctgcgggcccagcaggcgcagagggcatcggcgagcttgctgcaggcccccgccaggctggcagagaagtcgccctccgtccacatttccgcccctggcgagaagaggaggatcgcccacatccccaacccccgcctggctgcagcccccacaggtgccaagaggacccttgcggccagcggcagccagtcctccaacggccctgagccaggtggccagcagctgaaaacacgcacattgtcggggatggcgtccaagactaccaccaccatcatccctaagcgaatcgcccacagtccatccttacagagtttaaagaaacccattatccccaaagagtttgggggcaaagtccccaccgtcatccgccagcgctatctcaacctgttcatcgaggagtgtctcaagttctgtacctccaaccaggaggccatagagaaggcactgaacgaggagaaggtggcctatgaccgcagccccagcaagaacatctacctgaatgtggccgtgaacaccctcaagaagctcaggggcctggcccccagcgctgtgcccggcctcagcaaaaccagtggccgcagggttgtgtcccacgaggtggtgttggggggcaggttggccgccaagaccagcttctcgctcagccgtccaagcagcccccgggtggaggacctgaaaggggctgccctgtacagccgcctcagggagtacctgctcacccaggaccagctcaaggagaacggctaccccttcccgcacccagagcggcccgggggcgcaatcatcttcacagctgaggagaagaggcccaaggactcttcctgcaggacctgctgccgctgtggcaccgagtacctcgtgtcctcttcaggccgctgcatccgggacgaggagtgttattaccactggggacggctgcgccggaaccgggtggccggaggctgggagacccagtacatgtgctgctcggctgccgccggctctgtcggctgccaagtcgcaaagggtcccaaccagtgaatgggcgtgatggatggataggatggtcccgaagggctcagagatgtgctgctgctgccacccccgcccccactgcaccccgaagctgccctcacctgccttctccacccc

SEQ ID NO: 355530 - DNA, 370 bp, Homo sapiens
aggacaacaggcatctggaagtgctctctcgccactctgggtgctttactgtctctggcttgttccgacagaggatgatgcagatgtacagacacaagcgggccaacaaatagttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355531 - DNA, 252 bp, Homo sapiens
cgcgcaggcgctgtggcgcccctaggcttggcctcccagagactcgcggacgctcacgataaccaaggacgaccgcgaaccaaggtaaagccaacgaggccacctcgtgcgcgacggaggcgtctttgccgccccttccgggacgctcacggtggtcgccgcccccagcagggaaatgttttgcctccagagcgtccgcccagaagaagcggacagcgcgcttgcgcaagagagccgggccgcggcggcccg

SEQ ID NO: 355532 - DNA, 523 bp, Homo sapiens
agggcaaggctacagggaggggacatgcaggccatctttataatcagcctccacaaccctgcagtgtttacacggggagcagcagctcaggagtcatgcctgacaggtgctttatgttttgtagttgacatgaagacaatggagactgcagagaaactggctagatttgttgctcaggtgggaccagagatcgaacaattcagcatagaaaacagcaccgataaccctgacctgtgcgcctggccaaaaatatatatattttttagagacaaggtcttactctgtcacccaggcgcagtggctcgtgcctgtaatcccagcttagcgggactgaggcaagaggatcgcttgagcccgggagcttgagaccagcctgggcaagatggccagacctaatctttacaagaaaaaaaaattaatgtaaaaaaaatgaagtaaataattaaacttgtcacggatggcaggtagtgtatcagagtgcttgttatgtatgctcttcttggggggaggtggagttttttat

SEQ ID NO: 355533 - DNA, 465 bp, Homo sapiens
catctgttgcataaattgtgtttccaaagcttacaatagagcagccaggtctcagcactgctgggcacccaggttggctacttactttattattgcagactgtcctttaacattaaatgcacaacattcgtaccacttaaaactggggtcaggtggaagtctcacagagaccacgtctgtaccgcggttgccctgaaacagttaataggcttttaaagcctctcagatataacaaggttttaaaacatacttcatggaatgttcttcatgtatcatagcagctcatacctgtgatagaacaagctttcagtttttcctttctttcctttacattcactattcacagtgaaacaggtgcatgttttttttttcttttttttttcttttgtttctgttttttaagatctaagaagttgtgaatgttgttaatcatttagccgttgcaataaatgtagaggaaatgca

SEQ ID NO: 355534 - DNA, 7221 bp, Homo sapiens
agcggctgtgcggcgcggcgctgcggagaccgttggttcatttgcatgtccccgcctcgcgcggcggcggcggcgggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcagcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaatagggtatgttcacaggccagtgtgtaaggccgtctgccctcgctggcgtgctggtatgcagagaaatttcccccaacaaagttgatgttccctgctcccccaaaaatgccacacacaaaaaaaatcacaaaattctgtgagggaaacaaaagggtctatggatgtggatatgccccattcttaccttccaggtttgctgaaggagcaaacctcacactggccaagggcagatgcgcatggcctgcctggtgccccggctgtgagcccctcaaggcctccaggccagcctccgtggatgtgcgtgtggaaataggccacgcctgtctcttctcttgctcaagttttctctcacagatgacagccacctaccacataacatgaccagcaaacggactgttcctagtccagagggccttgccatcatgcaagtggaagggcgactgtgacagccactgccacagaggatggcagttggctgtgtccctttgtgagggtcttcaaatccttttccttctgcagggccttgggcctgtaaatatcctcatctttctattcttttttttttttagttgccccctcacctaatttccacctcagttttgaacaaaatcgttctcttcctgaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggcatcgtcaagtgctgtcttattacagcctttgtaaggagaggcaggctcctcctggggtgggctctgcagctgctctatttccaggcatgtgatcgcccccgctctccagattccccagcactctgctgcgtgtaactccactcaattctccactcatccttccttgtgaagcaggatcgttgaagttttaagtatgggcaaaaatctggaaaacttaggatccctctgacaccccaggattaggggacacagcagtggctagggcatcagccacagaactgagcgggaaatgccacttgtattggctgtaaagaaatcctggctttgggccaggcacagtggctcaagcctgtaatcccagcactttaggaggttgaggcggatggatcacctgaggtcaggagtttgagaccagcctggccaacatggtgtaaccccgtctctactaaaaatacaaaaaaattagccaggcgtggtagcgggcacctgtaatcccagctactcaggaggctgaggcaggagaatcacttgaaccggggaggcagaggttgcagtgagctgagatcatgccactccactccagcctgggcgacagagcaagactctgtctcaaaaaaaaaaaaggaaatcctggctttctttaagccacagacttcctaggctgtggtcccagctccttgtctgcctggtccctgtcaccttgcagtgccaccacccccaggggctctgcttgcttccagtggcttctgtagctttggcaactggcagatctttatggcagtagaggtgccagcatggaggatggagtttgggtttataacccaaccctcgaacgaaccagcctgtgggggcctggagtggagctggttttggggagtcacaggtgcggggggttcatcatctcctttctccttctcctttcctgacccctccgacagcttccatgttggccatgggtcaggtgaatggatggagctccaagcggggctcagcccattgacccgagcgaggcgcacacacctgcagcgtggatcaagcgcactctctccagcatcgccctgaccattccatgtgctttgtcctagcatgttcattcttgactttctccacttcattttattaaaaagttaaatgctttaggaatctgtggcgtgtggccactgaccgccccccacctcctgccgctcctccaagtttgagctgagatggttctgtgagtccttggcaggggtcaaagggcacatctccttgaacctagaaagccccctacactctcagaggacacctctcctgtggattcagcgctggggcagtgaaggtgtcgggagccagcagagcatggtgcgtgctgccagctgccggccagccgggatagaggagatgccactggccctccgtgcccccagcccctccctcttaaccgaggctgtccttgctctctgcagaggccgctctgcaggatcctcgtgtcgcgcgtgatgtgtggtggcacagccgtgtcaaagtcacagtgtcttttctgtcgttctagttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355535 - DNA, 7089 bp, Homo sapiens
agcggctgtgcggcgcggcgctgcggagaccgttggttcatttgcatgtccccgcctcgcgcggcggcggcggcgggtgaggagcctgaggcggcggcgggggtggctccgcgcgcggtggtctcgggatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcagcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaatagggtatgttcacaggccagtgtgtaaggccgtctgccctcgctggcgtgctggtatgcagagaaatttcccccaacaaagttgatgttccctgctcccccaaaaatgccacacacaaaaaaaatcacaaaattctgtgagggaaacaaaagggtctatggatgtggatatgccccattcttaccttccaggtttgctgaaggagcaaacctcacactggccaagggcagatgcgcatggcctgcctggtgccccggctgtgagcccctcaaggcctccaggccagcctccgtggatgtgcgtgtggaaataggccacgcctgtctcttctcttgctcaagttttctctcacagatgacagccacctaccacataacatgaccagcaaacggactgttcctagtccagagggccttgccatcatgcaagtggaagggcgactgtgacagccactgccacagaggatggcagttggctgtgtccctttgtgagggtcttcaaatccttttccttctgcagggccttgggcctgtaaatatcctcatctttctattcttttttttttttagttgccccctcacctaatttccacctcagttttgaacaaaatcgttctcttcctgaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggcatcgtcaagtgctgtcttattacagcctttgtaaggagaggcaggctcctcctggggtgggctctgcagctgctctatttccaggcatgtgatcgcccccgctctccagattccccagcactctgctgcgtgtaactccactcaattctccactcatccttccttgtgaagcaggatcgttgaagttttaagtatgggcaaaaatctggaaaacttaggatccctctgacaccccaggattaggggacacagcagtggctagggcatcagccacagaactgagcgggaaatgccacttgtattggctgtaaagaaatcctggctttgggccaggcacagtggctcaagcctgtaatcccagcactttaggaggttgaggcggatggatcacctgaggtcaggagtttgagaccagcctggccaacatggtgtaaccccgtctctactaaaaatacaaaaaaattagccaggcgtggtagcgggcacctgtaatcccagctactcaggaggctgaggcaggagaatcacttgaaccggggaggcagaggttgcagtgagctgagatcatgccactccactccagcctgggcgacagagcaagactctgtctcaaaaaaaaaaaaggaaatcctggctttctttaagccacagacttcctaggctgtggtcccagctccttgtctgcctggtccctgtcaccttgcagtgccaccacccccaggggctctgcttgcttccagtggcttctgtagctttggcaactggcagatctttatggcagtagaggtgccagcatggaggatggagtttgggtttataacccaaccctcgaacgaaccagcctgtgggggcctggagtggagctggttttggggagtcacaggtgcggggggttcatcatctcctttctccttctcctttcctgacccctccgacagcttccatgttggccatgggtcaggtgaatggatggagctccaagcggggctcagcccattgacccgagcgaggcgcacacacctgcagcgtggatcaagcgcactctctccagcatcgccctgaccattccatgtgctttgtcctagcatgttcattcttgactttctccacttcattttattaaaaagttaaatgctttaggaatctgtggcgtgtggccactgaccgccccccacctcctgccgctcctccaagtttgagctgagatggttctgtgagtccttggcaggggtcaaagggcacatctccttgaacctagaaagccccctacactctcagaggacacctctcctgtggattcagcgctggggcagtgaaggtgtcgggagccagcagagcatggtgcgtgctgccagctgccggccagccgggatagaggagatgccactggccctccgtgcccccagcccctccctcttaaccgaggctgtccttgctctctgcagaggccgctctgcaggatcctcgtgtcgcgcgtgatgtgtggtggcacagccgtgtcaaagtcacagtgtcttttctgtcgttctagttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355536 - DNA, 7169 bp, Homo sapiens
agcggctgtgcggcgcggcgctgcggagaccgttggttcatttgcatgtccccgcctcgcgcggcggcggcggcggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcagcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaatagggtatgttcacaggccagtgtgtaaggccgtctgccctcgctggcgtgctggtatgcagagaaatttcccccaacaaagttgatgttccctgctcccccaaaaatgccacacacaaaaaaaatcacaaaattctgtgagggaaacaaaagggtctatggatgtggatatgccccattcttaccttccaggtttgctgaaggagcaaacctcacactggccaagggcagatgcgcatggcctgcctggtgccccggctgtgagcccctcaaggcctccaggccagcctccgtggatgtgcgtgtggaaataggccacgcctgtctcttctcttgctcaagttttctctcacagatgacagccacctaccacataacatgaccagcaaacggactgttcctagtccagagggccttgccatcatgcaagtggaagggcgactgtgacagccactgccacagaggatggcagttggctgtgtccctttgtgagggtcttcaaatccttttccttctgcagggccttgggcctgtaaatatcctcatctttctattcttttttttttttagttgccccctcacctaatttccacctcagttttgaacaaaatcgttctcttcctgaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggcatcgtcaagtgctgtcttattacagcctttgtaaggagaggcaggctcctcctggggtgggctctgcagctgctctatttccaggcatgtgatcgcccccgctctccagattccccagcactctgctgcgtgtaactccactcaattctccactcatccttccttgtgaagcaggatcgttgaagttttaagtatgggcaaaaatctggaaaacttaggatccctctgacaccccaggattaggggacacagcagtggctagggcatcagccacagaactgagcgggaaatgccacttgtattggctgtaaagaaatcctggctttgggccaggcacagtggctcaagcctgtaatcccagcactttaggaggttgaggcggatggatcacctgaggtcaggagtttgagaccagcctggccaacatggtgtaaccccgtctctactaaaaatacaaaaaaattagccaggcgtggtagcgggcacctgtaatcccagctactcaggaggctgaggcaggagaatcacttgaaccggggaggcagaggttgcagtgagctgagatcatgccactccactccagcctgggcgacagagcaagactctgtctcaaaaaaaaaaaaggaaatcctggctttctttaagccacagacttcctaggctgtggtcccagctccttgtctgcctggtccctgtcaccttgcagtgccaccacccccaggggctctgcttgcttccagtggcttctgtagctttggcaactggcagatctttatggcagtagaggtgccagcatggaggatggagtttgggtttataacccaaccctcgaacgaaccagcctgtgggggcctggagtggagctggttttggggagtcacaggtgcggggggttcatcatctcctttctccttctcctttcctgacccctccgacagcttccatgttggccatgggtcaggtgaatggatggagctccaagcggggctcagcccattgacccgagcgaggcgcacacacctgcagcgtggatcaagcgcactctctccagcatcgccctgaccattccatgtgctttgtcctagcatgttcattcttgactttctccacttcattttattaaaaagttaaatgctttaggaatctgtggcgtgtggccactgaccgccccccacctcctgccgctcctccaagtttgagctgagatggttctgtgagtccttggcaggggtcaaagggcacatctccttgaacctagaaagccccctacactctcagaggacacctctcctgtggattcagcgctggggcagtgaaggtgtcgggagccagcagagcatggtgcgtgctgccagctgccggccagccgggatagaggagatgccactggccctccgtgcccccagcccctccctcttaaccgaggctgtccttgctctctgcagaggccgctctgcaggatcctcgtgtcgcgcgtgatgtgtggtggcacagccgtgtcaaagtcacagtgtcttttctgtcgttctagttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355537 - DNA, 7168 bp, Homo sapiens
agcggctgtgcggcgcggcgctgcggagaccgttggttcatttgcatgtccccgcctcgcgcggcggcggcggcgggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcagcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaatagggtatgttcacaggccagtgtgtaaggccgtctgccctcgctggcgtgctggtatgcagagaaatttcccccaacaaagttgatgttccctgctcccccaaaaatgccacacacaaaaaaaatcacaaaattctgtgagggaaacaaaagggtctatggatgtggatatgccccattcttaccttccaggtttgctgaaggagcaaacctcacactggccaagggcagatgcgcatggcctgcctggtgccccggctgtgagcccctcaaggcctccaggccagcctccgtggatgtgcgtgtggaaataggccacgcctgtctcttctcttgctcaagttttctctcacagatgacagccacctaccacataacatgaccagcaaacggactgttcctagtccagagggccttgccatcatgcaagtggaagggcgactgtgacagccactgccacagaggatggcagttggctgtgtccctttgtgagggtcttcaaatccttttccttctgcagggccttgggcctgtaaatatcctcatctttctattcttttttttttttagttgccccctcacctaatttccacctcagttttgaacaaaatcgttctcttcctgaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggcatcgtcaagtgctgtcttattacagcctttgtaaggagaggcaggctcctcctggggtgggctctgcagctgctctatttccaggcatgtgatcgcccccgctctccagattccccagcactctgctgcgtgtaactccactcaattctccactcatccttccttgtgaagcaggatcgttgaagttttaagtatgggcaaaaatctggaaaacttaggatccctctgacaccccaggattaggggacacagcagtggctagggcatcagccacagaactgagcgggaaatgccacttgtattggctgtaaagaaatcctggctttgggccaggcacagtggctcaagcctgtaatcccagcactttaggaggttgaggcggatggatcacctgaggtcaggagtttgagaccagcctggccaacatggtgtaaccccgtctctactaaaaatacaaaaaaattagccaggcgtggtagcgggcacctgtaatcccagctactcaggaggctgaggcaggagaatcacttgaaccggggaggcagaggttgcagtgagctgagatcatgccactccactccagcctgggcgacagagcaagactctgtctcaaaaaaaaaaaaggaaatcctggctttctttaagccacagacttcctaggctgtggtcccagctccttgtctgcctggtccctgtcaccttgcagtgccaccacccccaggggctctgcttgcttccagtggcttctgtagctttggcaactggcagatctttatggcagtagaggtgccagcatggaggatggagtttgggtttataacccaaccctcgaacgaaccagcctgtgggggcctggagtggagctggttttggggagtcacaggtgcggggggttcatcatctcctttctccttctcctttcctgacccctccgacagcttccatgttggccatgggtcaggtgaatggatggagctccaagcggggctcagcccattgacccgagcgaggcgcacacacctgcagcgtggatcaagcgcactctctccagcatcgccctgaccattccatgtgctttgtcctagcatgttcattcttgactttctccacttcattttattactcctgccgctcctccaagtttgagctgagatggttctgtgagtccttggcaggggtcaaagggcacatctccttgaacctagaaagccccctacactctcagaggacacctctcctgtggattcagcgctggggcagtgaaggtgtcgggagccagcagagcatggtgcgtgctgccagctgccggccagccgggatagaggagatgccactggccctccgtgcccccagcccctccctcttaaccgaggctgtccttgctctctgcagaggccgctctgcaggatcctcgtgtcgcgcgtgatgtgtggtggcacagccgtgtcaaagtcacagtgtcttttctgtcgttctagttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355538 - DNA, 6051 bp, Homo sapiens
agcggctgtgcggcgcggcgctgcggagaccgttggttcatttgcatgtccccgcctcgcgcggcggcggcggcgggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcagcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagaggcgagaacccaccagtacagcagagctgaagcctgttcccagaacgggtctcttgtcccattgcagtcccctgcccgattcagcaaccactgactgttttccaagccccagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgggaaccccctcggaaggggaagggttgggtgctgacgggcaggagcacaaagaagacacattcgatgtgttccgacagaggatgatgcagatgtacagacacaagcgggccaacaaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggcatcgtcaagtgctgtcttattacagcctttgtaaggagaggcaggctcctcctggggtgggctctgcagctgctctatttccaggcatgtgatcgcccccgctctccagattccccagcactctgctgcgtgtaactccactcaattctccactcatccttccttgtgaagcaggatcgttgaagttttaagtatgggcaaaaatctggaaaacttaggatccctctgacaccccaggattaggggacacagcagtggctagggcatcagccacagaactgagcgggaaatgccacttgtattggctgtaaagaaatcctggctttgggccaggcacagtggctcaagcctgtaatcccagcactttaggaggttgaggcggatggatcacctgaggtcaggagtttgagaccagcctggccaacatggtgtaaccccgtctctactaaaaatacaaaaaaattagccaggcgtggtagcgggcacctgtaatcccagctactcaggaggctgaggcaggagaatcacttgaaccggggaggcagaggttgcagtgagctgagatcatgccactccactccagcctgggcgacagagcaagactctgtctcaaaaaaaaaaaaggaaatcctggctttctttaagccacagacttcctaggctgtggtcccagctccttgtctgcctggtccctgtcaccttgcagtgccaccacccccaggggctctgcttgcttccagtggcttctgtagctttggcaactggcagatctttatggcagtagaggtgccagcatggaggatggagtttgggtttataacccaaccctcgaacgaaccagcctgtgggggcctggagtggagctggttttggggagtcacaggtgcggggggttcatcatctcctttctccttctcctttcctgacccctccgacagcttccatgttggccatgggtcaggtgaatggatggagctccaagcggggctcagcccattgacccgagcgaggcgcacacacctgcagcgtggatcaagcgcactctctccagcatcgccctgaccattccatgtgctttgtcctagcatgttcattcttgactttctccacttcattttattaaaaagttaaatgctttaggaatctgtggcgtgtggccactgaccgccccccacctcctgccgctcctccaagtttgagctgagatggttctgtgagtccttggcaggggtcaaagggcacatctccttgaacctagaaagccccctacactctcagaggacacctctcctgtggattcagcgctggggcagtgaaggtgtcgggagccagcagagcatggtgcgtgctgccagctgccggccagccgggatagaggagatgccactggccctccgtgcccccagcccctccctcttaaccgaggctgtccttgctctctgcagaggccgctctgcaggatcctcgtgtcgcgcgtgatgtgtggtggcacagccgtgtcaaagtcacagtgtcttttctgtcgttctagttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355539 - DNA, 7519 bp, Homo sapiens
agcggctgtgcggcgcggcgctgcggagaccgttggttcatttgcatgtccccgcctcgcgcggcggcggcggcgggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcagcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaatagggtatgttcacaggccagtgtgtaaggccgtctgccctcgctggcgtgctggtatgcagagaaatttcccccaacaaagttgatgttccctgctcccccaaaaatgccacacacaaaaaaaatcacaaaattctgtgagggaaacaaaagggtctatggatgtggatatgccccattcttaccttccaggtttgctgaaggagcaaacctcacactggccaagggcagatgcgcatggcctgcctggtgccccggctgtgagcccctcaaggcctccaggccagcctccgtggatgtgcgtgtggaaataggccacgcctgtctcttctcttgctcaagttttctctcacagatgacagccacctaccacataacatgaccagcaaacggactgttcctagtccagagggccttgccatcatgcaagtggaagggcgactgtgacagccactgccacagaggatggcagttggctgtgtccctttgtgagggtcttcaaatccttttccttctgcagggccttgggcctgtaaatatcctcatctttctattcttttttttttttagttgccccctcacctaatttccacctcagttttgaacaaaatcgttctcttcctgaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggcatcgtcaagtgctgtcttattacagcctttgtaaggagaggcaggctcctcctggggtgggctctgcagctgctctatttccaggcatgtgatcgcccccgctctccagattccccagcactctgctgcgtgtaactccactcaattctccactcatccttccttgtgaagcaggatcgttgaagttttaagtatgggcaaaaatctggaaaacttaggatccctctgacaccccaggattaggggacacagcagtggctagggcatcagccacagaactgagcgggaaatgccacttgtattggctgtaaagaaatcctggctttgggccaggcacagtggctcaagcctgtaatcccagcactttaggaggttgaggcggatggatcacctgaggtcaggagtttgagaccagcctggccaacatggtgtaaccccgtctctactaaaaatacaaaaaaattagccaggcgtggtagcgggcacctgtaatcccagctactcaggaggctgaggcaggagaatcacttgaaccggggaggcagaggttgcagtgagctgagatcatgccactccactccagcctgggcgacagagcaagctccatctccaaaaaaaaaaaaaaaaaaggccggcacggtgactcacgcctataattccaggcactttgggaggccgaggcaggtggatcacgaggtcaagagatcgagaccatcctggccaacatggtgaaaccctgtctctactaaaaatgcaaaaaattagctgggcgtggtggcgggcgcttgtagtcccagctactcaggaggctgaggcaggagaatcacttgaacccgggaggcggaggttgcagtgagccgagattgtgccaccgcactccagcctggcaacagagcgagactctgtctcaaaaaaaaaaaaggaaatcctggctttctttaagccacagacttcctaggctgtggtcccagctccttgtctgcctggtccctgtcaccttgcagtgccaccacccccaggggctctgcttgcttccagtggcttctgtagctttggcaactggcagatctttatggcagtagaggtgccagcatggaggatggagtttgggtttataacccaaccctcgaacgaaccagcctgtgggggcctggagtggagctggttttggggagtcacaggtgcggggggttcatcatctcctttctccttctcctttcctgacccctccgacagcttccatgttggccatgggtcaggtgaatggatggagctccaagcggggctcagcccattgacccgagcgaggcgcacacacctgcagcgtggatcaagcgcactctctccagcatcgccctgaccattccatgtgctttgtcctagcatgttcattcttgactttctccacttcattttattaaaaagttaaatgctttaggaatctgtggcgtgtggccactgaccgccccccacctcctgccgctcctccaagtttgagctgagatggttctgtgagtccttggcaggggtcaaagggcacatctccttgaacctagaaagccccctacactctcagaggacacctctcctgtggattcagcgctggggcagtgaaggtgtcgggagccagcagagcatggtgcgtgctgccagctgccggccagccgggatagaggagatgccactggccctccgtgcccccagcccctccctcttaaccgaggctgtccttgctctctgcagaggccgctctgcaggatcctcgtgtcgcgcgtgatgtgtggtggcacagccgtgtcaaagtcacagtgtcttttctgtcgttctagttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355540 - DNA, 6370 bp, Homo sapiens
tggggtgattgcacacattagtacttccatacagagactcattctttatatatcccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaatagggtatgttcacaggccagtgtgtaaggccgtctgccctcgctggcgtgctggtatgcagagaaatttcccccaacaaagttgatgttccctgctcccccaaaaatgccacacacaaaaaaaatcacaaaattctgtgagggaaacaaaagggtctatggatgtggatatgccccattcttaccttccaggtttgctgaaggagcaaacctcacactggccaagggcagatgcgcatggcctgcctggtgccccggctgtgagcccctcaaggcctccaggccagcctccgtggatgtgcgtgtggaaataggccacgcctgtctcttctcttgctcaagttttctctcacagatgacagccacctaccacataacatgaccagcaaacggactgttcctagtccagagggccttgccatcatgcaagtggaagggcgactgtgacagccactgccacagaggatggcagttggctgtgtccctttgtgagggtcttcaaatccttttccttctgcagggccttgggcctgtaaatatcctcatctttctattcttttttttttttagttgccccctcacctaatttccacctcagttttgaacaaaatcgttctcttcctgaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggcatcgtcaagtgctgtcttattacagcctttgtaaggagaggcaggctcctcctggggtgggctctgcagctgctctatttccaggcatgtgatcgcccccgctctccagattccccagcactctgctgcgtgtaactccactcaattctccactcatccttccttgtgaagcaggatcgttgaagttttaagtatgggcaaaaatctggaaaacttaggatccctctgacaccccaggattaggggacacagcagtggctagggcatcagccacagaactgagcgggaaatgccacttgtattggctgtaaagaaatcctggctttgggccaggcacagtggctcaagcctgtaatcccagcactttaggaggttgaggcggatggatcacctgaggtcaggagtttgagaccagcctggccaacatggtgtaaccccgtctctactaaaaatacaaaaaaattagccaggcgtggtagcgggcacctgtaatcccagctactcaggaggctgaggcaggagaatcacttgaaccggggaggcagaggttgcagtgagctgagatcatgccactccactccagcctgggcgacagagcaagactctgtctcaaaaaaaaaaaaggaaatcctggctttctttaagccacagacttcctaggctgtggtcccagctccttgtctgcctggtccctgtcaccttgcagtgccaccacccccaggggctctgcttgcttccagtggcttctgtagctttggcaactggcagatctttatggcagtagaggtgccagcatggaggatggagtttgggtttataacccaaccctcgaacgaaccagcctgtgggggcctggagtggagctggttttggggagtcacaggtgcggggggttcatcatctcctttctccttctcctttcctgacccctccgacagcttccatgttggccatgggtcaggtgaatggatggagctccaagcggggctcagcccattgacccgagcgaggcgcacacacctgcagcgtggatcaagcgcactctctccagcatcgccctgaccattccatgtgctttgtcctagcatgttcattcttgactttctccacttcattttattaaaaagttaaatgctttaggaatctgtggcgtgtggccactgaccgccccccacctcctgccgctcctccaagtttgagctgagatggttctgtgagtccttggcaggggtcaaagggcacatctccttgaacctagaaagccccctacactctcagaggacacctctcctgtggattcagcgctggggcagtgaaggtgtcgggagccagcagagcatggtgcgtgctgccagctgccggccagccgggatagaggagatgccactggccctccgtgcccccagcccctccctcttaaccgaggctgtccttgctctctgcagaggccgctctgcaggatcctcgtgtcgcgcgtgatgtgtggtggcacagccgtgtcaaagtcacagtgtcttttctgtcgttctagttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355541 - DNA, 5626 bp, Homo sapiens
agcggctgtgcggcgcggcgctgcggagaccgttggttcatttgcatgtccccgcctcgcgcggcggcggcggcgggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcagcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaatagggtatgttcacaggccagtgtgtaaggccgtctgccctcgctggcgtgctggtatgcagagaaatttcccccaacaaagttgatgttccctgctcccccaaaaatgccacacacaaaaaaaatcacaaaattctgtgagggaaacaaaagggtctatggatgtggatatgccccattcttaccttccaggtttgctgaaggagcaaacctcacactggccaagggcagatgcgcatggcctgcctggtgccccggctgtgagcccctcaaggcctccaggccagcctccgtggatgtgcgtgtggaaataggccacgcctgtctcttctcttgctcaagttttctctcacagatgacagccacctaccacataacatgaccagcaaacggactgttcctagtccagagggccttgccatcatgcaagtggaagggcgactgtgacagccactgccacagaggatggcagttggctgtgtccctttgtgagggtcttcaaatccttttccttctgcagggccttgggcctgtaaatatcctcatctttctattcttttttttttttagttgccccctcacctaatttccacctcagttttgaacaaaatcgttctcttcctgaatagatcaaaaccactgatgtgaaagataagccttgaagcagcaattgcccttaaaacatcatccctgccctggatcggcctggagccagtgcccaagtacggtgacagcttccatgttggccatgggtcaggtgaatggatggagctccaagcggggctcagcccattgacccgagcgaggcgcacacacctgcagcgtggatcaagcgcactctctccagcatcgccctgaccattccatgtgctttgtcctagcatgttcattcttgactttctccacttcattttattaaaaagttaaatgctttaggaatctgtggcgtgtggccactgaccgccccccacctcctgccgctcctccaagtttgagctgagatggttctgtgagtccttggcaggggtcaaagggcacatctccttgaacctagaaagccccctacactctcagaggacacctctcctgtggattcagcgctggggcagtgaaggtgtcgggagccagcagagcatggtgcgtgctgccagctgccggccagccgggatagaggagatgccactggccctccgtgcccccagcccctccctcttaaccgaggctgtccttgctctctgcagaggccgctctgcaggatcctcgtgtcgcgcgtgatgtgtggtggcacagccgtgtcaaagtcacagtgtcttttctgtcgttctagttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355542 - DNA, 5130 bp, Homo sapiens
ccagagcgggaagtgctaggggtgaggagcctcctcggggggcaccttacggttccatggtgcacatgttccagcagtaactgtgcagctcctcctggcatcgctccatgcttctcatacctgggaggaaccagagtcaaaatgggcacatggaggcccagagaggccagtgatgtaaccagaaagggtgagatgggtctcaagccagatctctattccagcattttcccaagccctgcataccttgttcgtccgcctctgtcccctggaaagcagttaggcttcttgaattctagctccttattaagttactagtactcctcaaattttctatcattgagaggctgcaccatcaagccatagccgcgtagagactggtcaggttattctttcccttgtcccacctccaccttccttggatcaatcccagcagtttcagcaaataaaaatgttgagagattccatctggttacccaatgtatttcctctgtgccccaggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaatagggtatgttcacaggccagtgtgtaaggccgtctgccctcgctggcgtgctggtatgcagagaaatttcccccaacaaagttgatgttccctgctcccccaaaaatgccacacacaaaaaaaatcacaaaattctgtgagggaaacaaaagggtctatggatgtggatatgccccattcttaccttccaggtttgctgaaggagcaaacctcacactggccaagggcagatgcgcatggcctgcctggtgccccggctgtgagcccctcaaggcctccaggccagcctccgtggatgtgcgtgtggaaataggccacgcctgtctcttctcttgctcaagttttctctcacagatgacagccacctaccacataacatgaccagcaaacggactgttcctagtccagagggccttgccatcatgcaagtggaagggcgactgtgacagccactgccacagaggatggcagttggctgtgtccctttgtgagggtcttcaaatccttttccttctgcagggccttgggcctgtaaatatcctcatctttctattcttttttttttttagttgccccctcacctaatttccacctcagttttgaacaaaatcgttctcttcctgaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggcatcgtcaagtgctgtcttattacagcctttgtaaggagaggcaggctcctcctggggtgggctctgcagctgctctatttccaggcatgtgatcgcccccgctctccagattccccagcactctgctgcgtgtaactccactcaattctccactcatccttccttgtgaagcaggatcgttgaagttttaagtatgggcaaaaatctggaaaacttaggatccctctgacaccccaggattaggggacacagcagtggctagggcatcagccacagaactgagcgggaaatgccacttgtattggctgtaaagaaatcctggctttgggccaggcacagtggctcaagcctgtaatcccagcactttaggaggttgaggcggatggatcacctgaggtcaggagtttgagaccagcctggccaacatggtgtaaccccgtctctactaaaaatacaaaaaaattagccaggcgtggtagcgggcacctgtaatcccagctactcaggaggctgaggcaggagaatcacttgaaccggggaggcagaggttgcagtgagctgagatcatgccactccactccagcctgggcgacagagcaagactctgtctcaaaaaaaaaaaaggaaatcctggctttctttaagccacagacttcctaggctgtggtcccagctccttgtctgcctggtccctgtcaccttgcagtgccaccacccccaggggctctgcttgcttccagtggcttctgtagctttggcaactggcagatctttatggcagtagaggtgccagcatggaggatggagtttgggtttataacccaaccctcgaacgaaccagcctgtgggggcctggagtggagctggttttggggagtcacaggtgcggggggttcatcatctcctttctccttctcctttcctgacccctccgacagcttccatgttggccatgggtcaggtgaatggatggagctccaagcggggctcagcccattgacccgagcgaggcgcacacacctgcagcgtggatcaagcgcactctctccagcatcgccctgaccattccatgtgctttgtcctagcatgttcattcttgactttctccacttcattttattaaaaagttaaatgctttaggaatctgtggcgtgtggccactgaccgccccccacctcctgccgctcctccaagtttgagctgagatggttctgtgagtccttggcaggggtcaaagggcacatctccttgaacctagaaagccccctacactctcagaggacacctctcctgtggattcagcgctggggcagtgaaggtgtcgggagccagcagagcatggtgcgtgctgccagctgccggccagccgggatagaggagatgccactggccctccgtgcccccagcccctccctcttaaccgaggctgtccttgctctctgcagaggccgctctgcaggatcctcgtgtcgcgcgtgatgtgtggtggcacagccgtgtcaaagtcacagtgtcttttctgtcgttctagttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355543 - DNA, 4466 bp, Homo sapiens
ataagctgcttcatgtcatgacagtgagatgggaacagagcaggggtggtcccaggcagtggtcagtgggacactgcctcggccatgagaggccatctcctgctctcctgtggggaggttccgggttcttgaggtataatttaccagcagtgaaacgcacccttttcaagtggaccatttgaattttgttgactgtgcagaggcgagaacccaccagtacagcagagctgaagcctgttcccagaacgggtctcttgtcccattgcagtcccctgcccgattcagcaaccactgactgttttccaagccccagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaatagggtatgttcacaggccagtgtgtaaggccgtctgccctcgctggcgtgctggtatgcagagaaatttcccccaacaaagttgatgttccctgctcccccaaaaatgccacacacaaaaaaaatcacaaaattctgtgagggaaacaaaagggtctatggatgtggatatgccccattcttaccttccaggtttgctgaaggagcaaacctcacactggccaagggcagatgcgcatggcctgcctggtgccccggctgtgagcccctcaaggcctccaggccagcctccgtggatgtgcgtgtggaaataggccacgcctgtctcttctcttgctcaagttttctctcacagatgacagccacctaccacataacatgaccagcaaacggactgttcctagtccagagggccttgccatcatgcaagtggaagggcgactgtgacagccactgccacagaggatggcagttggctgtgtccctttgtgagggtcttcaaatccttttccttctgcagggccttgggcctgtaaatatcctcatctttctattcttttttttttttagttgccccctcacctaatttccacctcagttttgaacaaaatcgttctcttcctgaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggcatcgtcaagtgctgtcttattacagcctttgtaaggagaggcaggctcctcctggggtgggctctgcagctgctctatttccaggcatgtgatcgcccccgctctccagattccccagcactctgctgcgtgtaactccactcaattctccactcatccttccttgtgaagcaggatcgttgaagttttaagtatgggcaaaaatctggaaaacttaggatccctctgacaccccaggattaggggacacagcagtggctagggcatcagccacagaactgagcgggaaatgccacttgtattggctgtaaagaaatcctggctttgggccaggcacagtggctcaagcctgtaatcccagcactttaggaggttgaggcggatggatcacctgaggtcaggagtttgagaccagcctggccaacatggtgtaaccccgtctctactaaaaatacaaaaaaattagccaggcgtggtagcgggcacctgtaatcccagctactcaggaggctgaggcaggagaatcacttgaaccggggaggcagaggttgcagtgagctgagatcatgccactccactccagcctgggcgacagagcaagactctgtctcaaaaaaaaaaaaggaaatcctggctttctttaagccacagacttcctaggctgtggtcccagctccttgtctgcctggtccctgtcaccttgcagtgccaccacccccaggggctctgcttgcttccagtggcttctgtagctttggcaactggcagatctttatggcagtagaggtgccagcatggaggatggagtttgggtttataacccaaccctcgaacgaaccagcctgtgggggcctggagtggagctggttttggggagtcacaggtgcggggggttcatcatctcctttctccttctcctttcctgacccctccgacagcttccatgttggccatgggtcaggtgaatggatggagctccaagcggggctcagcccattgacccgagcgaggcgcacacacctgcagcgtggatcaagcgcactctctccagcatcgccctgaccattccatgtgctttgtcctagcatgttcattcttgactttctccacttcattttattaaaaagttaaatgctttaggaatctgtggcgtgtggccactgaccgccccccacctcctgccgctcctccaagtttgagctgagatggttctgtgagtccttggcaggggtcaaagggcacatctccttgaacctagaaagccccctacactctcagaggacacctctcctgtggattcagcgctggggcagtgaaggtgtcgggagccagcagagcatggtgcgtgctgccagctgccggccagccgggatagaggagatgccactggccctccgtgcccccagcccctccctcttaaccgaggctgtccttgctctctgcagaggccgctctgcaggatcctcgtgtcgcgcgtgatgtgtggtggcacagccgtgtcaaagtcacagtgtcttttctgtcgttctagttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355544 - DNA, 5618 bp, Homo sapiens
  misc_feature (5433)..(5433): n is a, c, g, or t
  misc_feature (5437)..(5437): n is a, c, g, or t
  misc_feature (5444)..(5444): n is a, c, g, or t
  misc_feature (5446)..(5447): n is a, c, g, or t
  misc_feature (5451)..(5451): n is a, c, g, or t
  misc_feature (5454)..(5454): n is a, c, g, or t
  misc_feature (5462)..(5462): n is a, c, g, or t
  misc_feature (5617)..(5617): n is a, c, g, or t
agcggctgtgcggcgcggcgctgcggagaccgttggttcatttgcatgtccccgcctcgcgcggcggcggcggcgggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcagcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaatagggtatgttcacaggccagtgtgtaaggccgtctgccctcgctggcgtgctggtatgcagagaaatttcccccaacaaagttgatgttccctgctcccccaaaaatgccacacacaaaaaaaatcacaaaattctgtgagggaaacaaaagggtctatggatgtggatatgccccattcttaccttccaggtttgctgaaggagcaaacctcacactggccaagggcagatgcgcatggcctgcctggtgccccggctgtgagcccctcaaggcctccaggccagcctccgtggatgtgcgtgtggaaataggccacgcctgtctcttctcttgctcaagttttctctcacagatgacagccacctaccacataacatgaccagcaaacggactgttcctagtccagagggccttgccatcatgcaagtggaagggcgactgtgacagccactgccacagaggatggcagttggctgtgtccctttgtgagggtcttcaaatccttttccttctgcagggccttgggcctgtaaatatcctcatctttctattcttttttttttttagttgccccctcacctaatttccacctcagttttgaacaaaatcgttctcttcctgaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggncgcnaggcgtntnnagcntgnaggagagncccggggggctggagtctattcggattgagcccgtctcgattccaactttgggttccaattcatctcggaagaacggtatggcaatgataatctcccagggctcgctcaacccacttaaatggggcacaaccggagggtaataagcgagcaagcna

SEQ ID NO: 355545 - DNA, 5392 bp, Homo sapiens
agcggctgtgcggcgcggcgctgcggagaccgttggttcatttgcatgtccccgcctcgcgcggcggcggcggcgggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcagcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaatagggtatgttcacaggccagtgtgtaaggccgtctgccctcgctggcgtgctggtatgcagagaaatttcccccaacaaagttgatgttccctgctcccccaaaaatgccacacacaaaaaaaatcacaaaattctgtgagggaaacaaaagggtctatggatgtggatatgccccattcttaccttccaggtttgctgaaggagcaaacctcacactggccaagggcagatgcgcatggcctgcctggtgccccggctgtgagcccctcaaggcctccaggccagcctccgtggatgtgcgtgtggaaataggccacgcctgtctcttctcttgctcaagttttctctcacagatgacagccacctaccacataacatgaccagcaaacggactgttcctagtccagagggccttgccatcatgcaagtggaagggcgactgtgacagccactgccacagaggatggcagttggctgtgtccctttgtgagggtcttcaaatccttttccttctgcagggccttgggcctgtaaatatcctcatctttctattcttttttttttttagttgccccctcacctaatttccacctcagttttgaacaaaatcgttctcttcctgaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccgttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355546 - DNA, 4402 bp, Homo sapiens
agcggctgtgcggcgcggcgctgcggagaccgttggttcatttgcatgtccccgcctcgcgcggcggcggcggcgggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcagcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaatagatcaaaaccactgatgtgaaagataagccttgaagcagcaattgcccttaaaacatcatccctgccctggatcggcctggagccagtgcccaagtacggtttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355547 - DNA, 4381 bp, Homo sapiens
agcggctgtgcggcgcggcgctgcggagaccgttggttcatttgcatgtccccgcctcgcgcggcggcggcggcgggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcagcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaatagagtccatgaaccagttcgaattgcctatgacaggcctcggggtcgtcccatgtccaaaaagaagaaacccaaggacttggacttcgcccagcagaagctgaccgataagcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355548 - DNA, 1693 bp, Homo sapiens
agcggctgtgcggcgcggcgctgcggagaccgttggttcatttgcatgtccccgcctcgcgcggcggcggcggcgggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcagcagtcaagtccaggccagaggtcgagctctaaacatcgttgaccaggaaggttccctcctaggaaagggggagactcagggcgacagcttccatgttggccatgggtcaggtgaatggatggagctccaagcggggctcagcccattgacccgagcgaggcgcacacacctgcagcgtggatcaagcgcactctctccagcatcgccctgaccattccatgtgctttgtcctagcatgttcattcttgactttctccacttcattttattaaaaagttaaatgctttaggaatctgtggcgtgtggccactgaccgccccccacctcctgccgctcctccaagtttgagctgagatggttctgtgagtccttggcaggggtcaaagggcacatctccttgaacctagaaagccccctacactctcagaggacacctctcctgtggattcagcgctggggcagtgaaggtgtcgggagccagcagagcatggtgcgtgctgccagctgccggccagccgggatagaggagatgccactggccctccgtgcccccagcccctccctcttaaccgaggctgtccttgctctctgcagaggccgctctgcaggatcctcgtgtcgcgcgtgatgtgtggtggcacagccgtgtcaaagtcacagtgtcttttctgtcgttctagttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355549 - DNA, 1150 bp, Homo sapiens
gggtagtacgaggctggtggtgaatcggcgaggcgctccttgtctgcctggtccctgtcaccttgcagtgccaccacccccaggggctctgcttgcttccagtggcttctgtagctttggcaactggcagatctttatggcagtagaggtgccagcatggaggatggagtttgggtttataacccaaccctcgaacgaaccagcctgtgggggcctggagtggagctggttttggggagtcacaggtgcggggggttcatcatctcctttctccttctcctttcctgacccctccgacagcttccatgttggccatgggtcaggtgaatggatggagctccaagcggggctcagcccattgacccgagcgaggcgcacacacctgcagcgtggatcaagcgcactctctccagcatcgccctgaccattccatgtgctttgtcctagcatgttcattcttgactttctccacttcattttattaaaaagttaaatgctttaggaatctgtggcgtgtggccactgaccgccccccacctcctgccgctcctccaagtttgagctgagatggttctgtgagtccttggcaggggtcaaagggcacatctccttgaacctagaaagccccctacactctcagaggacacctctcctgtggattcagcgctggggcagtgaaggtgtcgggagccagcagagcatggtgcgtgctgccagctgccggccagccgggatagaggagatgccactggccctccgtgcccccagcccctccctcttaaccgaggctgtccttgctctctgcagaggccgctctgcaggatcctcgtgtcgcgcgtgatgtgtggtggcacagccgtgtcaaagtcacagtgtcttttctgtcgttctagttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355550 - DNA, 2257 bp, Homo sapiens
agcggctgtgcggcgcggcgctgcggagaccgttggttcatttgcatgtccccgcctcgcgcggcggcggcggcgggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcagcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355551 - DNA, 941 bp, Homo sapiens
ataagctgcttcatgtcatgacagtgagatgggaacagagcaggggtggtcccaggcagtggtcagtgggacactgcctcggccatgagaggccatctcctgctctcctgtggggaggttccgggttcttgaggtataatttaccagcagtgaaacgcacccttttcaagtggaccatttgaattttgttgactgtgcagaggcgagaacccaccagtacagcagagctgaagcctgttcccagaacgggtctcttgtcccattgcagtcccctgcccgattcagcaaccactgactgttttccaagccccaggtattctatctttcctagtctgtcagtacatagaattgcatcgcatgtggccttttgatgggcacgccgtggcccagatgactcctgtagcccccaagtgccctccaagctgtctccccacagtcaggcctggaccgtgctttcacatgggacttctgctgcaaaacctatgtgtgaagttgtagtgaatggtgccccattgtgggactgtgttaaacagtcacctgtgtgttctacatcattcagacagtcacatttacatgtgacagtggccttatggtttttcctgctttggaatagtcctcatgttttgtgtttgaaaaatttggtgttgcagtgaaatgctaaccattctactataacctttaccatccttcaaaacttctcatggggccaggcgcagtggctcgtgcctgtaatcccagcttagcgggactgaggcaagaggatcgcttgagcccgggagcttgagaccagcctgggcaagatggccagacctaatctttacaagaaaaaaaaattaatgtaaaaaaaatgaagtaaataattaaacttgtcacggatggcaggtagtgtatcagagtgcttgttatgtatgctcttcttggggggaggtggagttttttat

SEQ ID NO: 355552 - DNA, 364 bp, Homo sapiens
gaatcgatgctccgtaccttacgatgtcgctgtgcgatgatccacctagaagaaacccaaggacttggacttcgcccagcagaagctgaccgataagaacctgggcttccagatgctgcagaagatgggctggaaggagggccatggcctgggctccctcggaaagggcatcagggagccggtcagcgtgggaaccccctcggaaggggaagggttgggtgctgacgggcaggagcacaaagaagacacattcgatgtgttccgacagaggatgatgcagatgtacagacacaagcgggccaacaaatagatcaaaaccactgatgtgaaagattaacaagttttttttttttttttttttttt

SEQ ID NO: 355553 - DNA, 7177 bp, Homo sapiens
cgcgcaggcgctgtggcgcccctaggcttggcctcccagagactcgcggacgctcacgataaccaaggacgaccgcgaaccaagggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcagcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaatagggtatgttcacaggccagtgtgtaaggccgtctgccctcgctggcgtgctggtatgcagagaaatttcccccaacaaagttgatgttccctgctcccccaaaaatgccacacacaaaaaaaatcacaaaattctgtgagggaaacaaaagggtctatggatgtggatatgccccattcttaccttccaggtttgctgaaggagcaaacctcacactggccaagggcagatgcgcatggcctgcctggtgccccggctgtgagcccctcaaggcctccaggccagcctccgtggatgtgcgtgtggaaataggccacgcctgtctcttctcttgctcaagttttctctcacagatgacagccacctaccacataacatgaccagcaaacggactgttcctagtccagagggccttgccatcatgcaagtggaagggcgactgtgacagccactgccacagaggatggcagttggctgtgtccctttgtgagggtcttcaaatccttttccttctgcagggccttgggcctgtaaatatcctcatctttctattcttttttttttttagttgccccctcacctaatttccacctcagttttgaacaaaatcgttctcttcctgaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggcatcgtcaagtgctgtcttattacagcctttgtaaggagaggcaggctcctcctggggtgggctctgcagctgctctatttccaggcatgtgatcgcccccgctctccagattccccagcactctgctgcgtgtaactccactcaattctccactcatccttccttgtgaagcaggatcgttgaagttttaagtatgggcaaaaatctggaaaacttaggatccctctgacaccccaggattaggggacacagcagtggctagggcatcagccacagaactgagcgggaaatgccacttgtattggctgtaaagaaatcctggctttgggccaggcacagtggctcaagcctgtaatcccagcactttaggaggttgaggcggatggatcacctgaggtcaggagtttgagaccagcctggccaacatggtgtaaccccgtctctactaaaaatacaaaaaaattagccaggcgtggtagcgggcacctgtaatcccagctactcaggaggctgaggcaggagaatcacttgaaccggggaggcagaggttgcagtgagctgagatcatgccactccactccagcctgggcgacagagcaagactctgtctcaaaaaaaaaaaaggaaatcctggctttctttaagccacagacttcctaggctgtggtcccagctccttgtctgcctggtccctgtcaccttgcagtgccaccacccccaggggctctgcttgcttccagtggcttctgtagctttggcaactggcagatctttatggcagtagaggtgccagcatggaggatggagtttgggtttataacccaaccctcgaacgaaccagcctgtgggggcctggagtggagctggttttggggagtcacaggtgcggggggttcatcatctcctttctccttctcctttcctgacccctccgacagcttccatgttggccatgggtcaggtgaatggatggagctccaagcggggctcagcccattgacccgagcgaggcgcacacacctgcagcgtggatcaagcgcactctctccagcatcgccctgaccattccatgtgctttgtcctagcatgttcattcttgactttctccacttcattttattaaaaagttaaatgctttaggaatctgtggcgtgtggccactgaccgccccccacctcctgccgctcctccaagtttgagctgagatggttctgtgagtccttggcaggggtcaaagggcacatctccttgaacctagaaagccccctacactctcagaggacacctctcctgtggattcagcgctggggcagtgaaggtgtcgggagccagcagagcatggtgcgtgctgccagctgccggccagccgggatagaggagatgccactggccctccgtgcccccagcccctccctcttaaccgaggctgtccttgctctctgcagaggccgctctgcaggatcctcgtgtcgcgcgtgatgtgtggtggcacagccgtgtcaaagtcacagtgtcttttctgtcgttctagttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355554 - DNA, 7423 bp, Homo sapiens
ggccttgggggcccgccccgggctccgtgatggcgtcgcaggctcggccctctggctgcggcggcggccgcgtccccgccgggttggcctgggtggccggctgcggcctcccgggcccggcgcccccatttcctcgcccgcagaggccgggagacggcgggccgcgtccacaaaggctcattggttcagtcgttcattcattcctcccgaactcggagcggcccccgctcgggaggagataacggcgcccagcgctgcatcgggcccttgccctctttagaaccggttcagcccccacaccagcccctttactggctgcccattccatagggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcagcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaatagggtatgttcacaggccagtgtgtaaggccgtctgccctcgctggcgtgctggtatgcagagaaatttcccccaacaaagttgatgttccctgctcccccaaaaatgccacacacaaaaaaaatcacaaaattctgtgagggaaacaaaagggtctatggatgtggatatgccccattcttaccttccaggtttgctgaaggagcaaacctcacactggccaagggcagatgcgcatggcctgcctggtgccccggctgtgagcccctcaaggcctccaggccagcctccgtggatgtgcgtgtggaaataggccacgcctgtctcttctcttgctcaagttttctctcacagatgacagccacctaccacataacatgaccagcaaacggactgttcctagtccagagggccttgccatcatgcaagtggaagggcgactgtgacagccactgccacagaggatggcagttggctgtgtccctttgtgagggtcttcaaatccttttccttctgcagggccttgggcctgtaaatatcctcatctttctattcttttttttttttagttgccccctcacctaatttccacctcagttttgaacaaaatcgttctcttcctgaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggcatcgtcaagtgctgtcttattacagcctttgtaaggagaggcaggctcctcctggggtgggctctgcagctgctctatttccaggcatgtgatcgcccccgctctccagattccccagcactctgctgcgtgtaactccactcaattctccactcatccttccttgtgaagcaggatcgttgaagttttaagtatgggcaaaaatctggaaaacttaggatccctctgacaccccaggattaggggacacagcagtggctagggcatcagccacagaactgagcgggaaatgccacttgtattggctgtaaagaaatcctggctttgggccaggcacagtggctcaagcctgtaatcccagcactttaggaggttgaggcggatggatcacctgaggtcaggagtttgagaccagcctggccaacatggtgtaaccccgtctctactaaaaatacaaaaaaattagccaggcgtggtagcgggcacctgtaatcccagctactcaggaggctgaggcaggagaatcacttgaaccggggaggcagaggttgcagtgagctgagatcatgccactccactccagcctgggcgacagagcaagactctgtctcaaaaaaaaaaaaggaaatcctggctttctttaagccacagacttcctaggctgtggtcccagctccttgtctgcctggtccctgtcaccttgcagtgccaccacccccaggggctctgcttgcttccagtggcttctgtagctttggcaactggcagatctttatggcagtagaggtgccagcatggaggatggagtttgggtttataacccaaccctcgaacgaaccagcctgtgggggcctggagtggagctggttttggggagtcacaggtgcggggggttcatcatctcctttctccttctcctttcctgacccctccgacagcttccatgttggccatgggtcaggtgaatggatggagctccaagcggggctcagcccattgacccgagcgaggcgcacacacctgcagcgtggatcaagcgcactctctccagcatcgccctgaccattccatgtgctttgtcctagcatgttcattcttgactttctccacttcattttattaaaaagttaaatgctttaggaatctgtggcgtgtggccactgaccgccccccacctcctgccgctcctccaagtttgagctgagatggttctgtgagtccttggcaggggtcaaagggcacatctccttgaacctagaaagccccctacactctcagaggacacctctcctgtggattcagcgctggggcagtgaaggtgtcgggagccagcagagcatggtgcgtgctgccagctgccggccagccgggatagaggagatgccactggccctccgtgcccccagcccctccctcttaaccgaggctgtccttgctctctgcagaggccgctctgcaggatcctcgtgtcgcgcgtgatgtgtggtggcacagccgtgtcaaagtcacagtgtcttttctgtcgttctagttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355555 - DNA, 5938 bp, Homo sapiens
agcggctgtgcggcgcggcgctgcggagaccgttggttcatttgcatgtccccgcctcgcgcggcggcggcggcgggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcagcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgggaaccccctcggaaggggaagggttgggtgctgacgggcaggagcacaaagaagacacattcgatgtgttccgacagaggatgatgcagatgtacagacacaagcgggccaacaaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggcatcgtcaagtgctgtcttattacagcctttgtaaggagaggcaggctcctcctggggtgggctctgcagctgctctatttccaggcatgtgatcgcccccgctctccagattccccagcactctgctgcgtgtaactccactcaattctccactcatccttccttgtgaagcaggatcgttgaagttttaagtatgggcaaaaatctggaaaacttaggatccctctgacaccccaggattaggggacacagcagtggctagggcatcagccacagaactgagcgggaaatgccacttgtattggctgtaaagaaatcctggctttgggccaggcacagtggctcaagcctgtaatcccagcactttaggaggttgaggcggatggatcacctgaggtcaggagtttgagaccagcctggccaacatggtgtaaccccgtctctactaaaaatacaaaaaaattagccaggcgtggtagcgggcacctgtaatcccagctactcaggaggctgaggcaggagaatcacttgaaccggggaggcagaggttgcagtgagctgagatcatgccactccactccagcctgggcgacagagcaagactctgtctcaaaaaaaaaaaaggaaatcctggctttctttaagccacagacttcctaggctgtggtcccagctccttgtctgcctggtccctgtcaccttgcagtgccaccacccccaggggctctgcttgcttccagtggcttctgtagctttggcaactggcagatctttatggcagtagaggtgccagcatggaggatggagtttgggtttataacccaaccctcgaacgaaccagcctgtgggggcctggagtggagctggttttggggagtcacaggtgcggggggttcatcatctcctttctccttctcctttcctgacccctccgacagcttccatgttggccatgggtcaggtgaatggatggagctccaagcggggctcagcccattgacccgagcgaggcgcacacacctgcagcgtggatcaagcgcactctctccagcatcgccctgaccattccatgtgctttgtcctagcatgttcattcttgactttctccacttcattttattaaaaagttaaatgctttaggaatctgtggcgtgtggccactgaccgccccccacctcctgccgctcctccaagtttgagctgagatggttctgtgagtccttggcaggggtcaaagggcacatctccttgaacctagaaagccccctacactctcagaggacacctctcctgtggattcagcgctggggcagtgaaggtgtcgggagccagcagagcatggtgcgtgctgccagctgccggccagccgggatagaggagatgccactggccctccgtgcccccagcccctccctcttaaccgaggctgtccttgctctctgcagaggccgctctgcaggatcctcgtgtcgcgcgtgatgtgtggtggcacagccgtgtcaaagtcacagtgtcttttctgtcgttctagttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355556 - DNA, 7031 bp, Homo sapiens
agcggctgtgcggcgcggcgctgcggagaccgttggttcatttgcatgtccccgcctcgcgcggcggcggcggcgggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcagcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaatagggtatgttcacaggccagtgtgtaaggccgtctgccctcgctggcgtgctggtatgcagagaaatttcccccaacaaagttgatgttccctgctcccccaaaaatgccacacacaaaaaaaatcacaaaattctgtgagggaaacaaaagggtctatggatgtggatatgccccattcttaccttccaggtttgctgaaggagcaaacctcacactggccaagggcagatgcgcatggcctgcctggtgccccggctgtgagcccctcaaggcctccaggccagcctccgtggatgtgcgtgtggaaataggccacgcctgtctcttctcttgctcaagttttctctcacagatgacagccacctaccacataacatgaccagcaaacggactgttcctagtccagagggccttgccatcatgcaagtggaagggcgactgtgacagccactgccacagaggatggcagttggctgtgtccctttgtgagggtcttcaaatccttttccttctgcagggccttgggcctgtaaatatcctcatctttctattcttttttttttttagttgccccctcacctaatttccacctcagttttgaacaaaatcgttctcttcctgaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggcatcgtcaagtgctgtcttattacagcctttgtaaggagaggcaggctcctcctggggtgggctctgcagctgctctatttccaggcatgtgatcgcccccgctctccagattccccagcactctgctgcgtgtaactccactcaattctccactcatccttccttgtgaagcaggatcgttgaagttttaagtatgggcaaaaatctggaaaacttaggatccctctgacaccccaggattaggggacacagcagtggctagggcatcagccacagaactgagcgggaaatgccacttgtattggctgtaaagaaatcctggctttgggccaggcacagtggctcaagcctgtaatcccagcactttaggaggttgaggcggatggatcacctgaggtcaggagtttgagaccagcctggccaacatggtgtaaccccgtctctactaaaaatacaaaaaaattagccaggcgtggtagcgggcacctgtaatcccagctactcaggaggctgaggcaggagaatcacttgaaccggggaggcagaggttgcagtgagctgagatcatgccactccactccagcctgggcgacagagcaagactctgtctcaaaaaaaaaaaaggaaatcctggctttctttaagccacagacttcctaggctgtggtcccagctccttgtctgcctggtccctgtcaccttgcagtgccaccacccccaggggctctgcttgcttccagtggcttctgtagctttggcaactggcagatctttatggcagtagaggtgccagcatggaggatggagtttgggtttataacccaaccctcgaacgaaccagcctgtgggggcctggagtggagctggttttggggagtcacaggtgcggggggttcatcatctcctttctccttctcctttcctgacccctccgacagcttccatgttggccatgggtcaggtgaatggatggagctccaagcggggctcagcccattgacccgagcgaggcgcacacacctgcagcgtggatcaagcgcactctctccagcatcgccctgaccattccatgtgctttgtcctagcatgttcattcttgactttctccacttcattttattaaaaagttaaatgctttaggaatctgtggcgtgtggccactgaccgccccccacctcctgccgctcctccaagtttgagctgagatggttctgtgagtccttggcaggggtcaaagggcacatctccttgaacctagaaagccccctacactctcagaggacacctctcctgtggattcagcgctggggcagtgaaggtgtcgggagccagcagagcatgttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355557 - DNA, 7082 bp, Homo sapiens
agcggctgtgcggcgcggcgctgcggagaccgttggttcatttgcatgtccccgcctcgcgcggcggcggcggcgggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcagcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaatagggtatgttcacaggccagtgtgtaaggccgtctgccctcgctggcgtgctggtatgcagagaaatttcccccaacaaagttgatgttccctgctcccccaaaaatgccacacacaaaaaaaatcacaaaattctgtgagggaaacaaaagggtctatggatgtggatatgccccattcttaccttccaggtttgctgaaggagcaaacctcacactggccaagggcagatgcgcatggcctgcctggtgccccggctgtgagcccctcaaggcctccaggccagcctccgtggatgtgcgtgtggaaataggccacgcctgtctcttctcttgctcaagttttctctcacagatgacagccacctaccacataacatgaccagcaaacggactgttcctagtccagagggccttgccatcatgcaagtggaagggcgactgtgacagccactgccacagaggatggcagttggctgtgtccctttgtgagggtcttcaaatccttttccttctgcagggccttgggcctgtaaatatcctcatctttctattcttttttttttttagttgccccctcacctaatttccacctcagttttgaacaaaatcgttctcttcctgaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggcatcgtcaagtgctgtcttattacagcctttgtaaggagaggcaggctcctcctggggtgggctctgcagctgctctatttccaggcatgtgatcgcccccgctctccagattccccagcactctgctgcgtgtaactccactcaattctccactcatccttccttgtgaagcaggatcgttgaagttttaagtatgggcaaaaatctggaaaacttaggatccctctgacaccccaggattaggggacacagcagtggctagggcatcagccacagaactgagcgggaaatgccacttgtattggctgtaaagaaatcctggctttgggccaggcacagtggctcaagcctgtaatcccactactcaggaggctgaggcaggagaatcacttgaacccgggaggcggaggttgcagtgagccgagattgtgccaccgcactccagcctggcaacagagcgagactctgtctcaaaaaaaaaaaaggaaatcctggctttctttaagccacagacttcctaggctgtggtcccagctccttgtctgcctggtccctgtcaccttgcagtgccaccacccccaggggctctgcttgcttccagtggcttctgtagctttggcaactggcagatctttatggcagtagaggtgccagcatggaggatggagtttgggtttataacccaaccctcgaacgaaccagcctgtgggggcctggagtggagctggttttggggagtcacaggtgcggggggttcatcatctcctttctccttctcctttcctgacccctccgacagcttccatgttggccatgggtcaggtgaatggatggagctccaagcggggctcagcccattgacccgagcgaggcgcacacacctgcagcgtggatcaagcgcactctctccagcatcgccctgaccattccatgtgctttgtcctagcatgttcattcttgactttctccacttcattttattaaaaagttaaatgctttaggaatctgtggcgtgtggccactgaccgccccccacctcctgccgctcctccaagtttgagctgagatggttctgtgagtccttggcaggggtcaaagggcacatctccttgaacctagaaagccccctacactctcagaggacacctctcctgtggattcagcgctggggcagtgaaggtgtcgggagccagcagagcatggtgcgtgctgccagctgccggccagccgggatagaggagatgccactggccctccgtgcccccagcccctccctcttaaccgaggctgtccttgctctctgcagaggccgctctgcaggatcctcgtgtcgcgcgtgatgtgtggtggcacagccgtgtcaaagtcacagtgtcttttctgtcgttctagttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355558 - DNA, 4964 bp, Homo sapiens
aacctgggaccgcaacagttgaaggagctatatcttgcaggccgacagcttctaagattttctcctgccggaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaatagggtatgttcacaggccagtgtgtaaggccgtctgccctcgctggcgtgctggtatgcagagaaatttcccccaacaaagttgatgttccctgctcccccaaaaatgccacacacaaaaaaaatcacaaaattctgtgagggaaacaaaagggtctatggatgtggatatgccccattcttaccttccaggtttgctgaaggagcaaacctcacactggccaagggcagatgcgcatggcctgcctggtgccccggctgtgagcccctcaaggcctccaggccagcctccgtggatgtgcgtgtggaaataggccacgcctgtctcttctcttgctcaagttttctctcacagatgacagccacctaccacataacatgaccagcaaacggactgttcctagtccagagggccttgccatcatgcaagtggaagggcgactgtgacagccactgccacagaggatggcagttggctgtgtccctttgtgagggtcttcaaatccttttccttctgcagggccttgggcctgtaaatatcctcatctttctattcttttttttttttagttgccccctcacctaatttccacctcagttttgaacaaaatcgttctcttcctgaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggcatcgtcaagtgctgtcttattacagcctttgtaaggagaggcaggctcctcctggggtgggctctgcagctgctctatttccaggcatgtgatcgcccccgctctccagattccccagcactctgctgcgtgtaactccactcaattctccactcatccttccttgtgaagcaggatcgttgaagttttaagtatgggcaaaaatctggaaaacttaggatccctctgacaccccaggattaggggacacagcagtggctagggcatcagccacagaactgagcgggaaatgccacttgtattggctgtaaagaaatcctggctttgggccaggcacagtggctcaagcctgtaatcccagcactttaggaggttgaggcggatggatcacctgaggtcaggagtttgagaccagcctggccaacatggtgtaaccccgtctctactaaaaatacaaaaaaattagccaggcgtggtagcgggcacctgtaatcccagctactcaggaggctgaggcaggagaatcacttgaaccggggaggcagaggttgcagtgagctgagatcatgccactccactccagcctgggcgacagagcaagactctgtctcaaaaaaaaaaaaggaaatcctggctttctttaagccacagacttcctaggctgtggtcccagctccttgtctgcctggtccctgtcaccttgcagtgccaccacccccaggggctctgcttgcttccagtggcttctgtagctttggcaactggcagatctttatggcagtagaggtgccagcatggaggatggagtttgggtttataacccaaccctcgaacgaaccagcctgtgggggcctggagtggagctggttttggggagtcacaggtgcggggggttcatcatctcctttctccttctcctttcctgacccctccgacagcttccatgttggccatgggtcaggtgaatggatggagctccaagcggggctcagcccattgacccgagcgaggcgcacacacctgcagcgtggatcaagcgcactctctccagcatcgccctgaccattccatgtgctttgtcctagcatgttcattcttgactttctccacttcattttattaaaaagttaaatgctttaggaatctgtggcgtgtggccactgaccgccccccacctcctgccgctcctccaagtttgagctgagatggttctgtgagtccttggcaggggtcaaagggcacatctccttgaacctagaaagccccctacactctcagaggacacctctcctgtggattcagcgctggggcagtgaaggtgtcgggagccagcagagcatggtgcgtgctgccagctgccggccagccgggatagaggagatgccactggccctccgtgcccccagcccctccctcttaaccgaggctgtccttgctctctgcagaggccgctctgcaggatcctcgtgtcgcgcgtgatgtgtggtggcacagccgtgtcaaagtcacagtgtcttttctgtcgttctagttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355559 - DNA, 3645 bp, Homo sapiens
agcggctgtgcggcgcggcgctgcggagaccgttggttcatttgcatgtccccgcctcgcgcggcggcggcggcgggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcagcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgggaaccccctcggaaggggaagggttgggtgctgacgggcaggagcacaaagaagacacattcgatgtgttccgacagaggatgatgcagatgtacagacacaagcgggccaacaaatagttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355560 - DNA, 3745 bp, Homo sapiens
agcggctgtgcggcgcggcgctgcggagaccgttggttcatttgcatgtccccgcctcgcgcggcggcggcggcgggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcagcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgggaaccccctcggaaggggaagggttgggtgctgacgggcaggagcacaaagaagacacattcgatgtgttccgacagaggatgatgcagatgtacagacacaagcgggccaacaaatagatcaaaaccactgatgtgaaagataagccttgaagcagcaattgcccttaaaacatcatccctgccctggatcggcctggagccagtgcccaagtacggtttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355561 - DNA, 4302 bp, Homo sapiens
agcggctgtgcggcgcggcgctgcggagaccgttggttcatttgcatgtccccgcctcgcgcggcggcggcggcgggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcagcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaatagttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 355562 - DNA, 3809 bp, Homo sapiens
agcggctgtgcggcgcggcgctgcggagaccgttggttcatttgcatgtccccgcctcgcgcggcggcggcggcgggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcagcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagaggcgagaacccaccagtacagcagagctgaagcctgttcccagaacgggtctcttgtcccattgcagtcccctgcccgattcagcaaccactgactgttttccaagccccaggtattctatctttcctagtctgtcagtacatagaattgcatcgcatgtggccttttgatgggcacgccgtggcccagatgactcctgtagcccccaagtgccctccaagctgtctccccacagtcaggcctggaccgtgctttcacatgggacttctgctgcaaaacctatgtgtgaagttgtagtgaatggtgccccattgtgggactgtgttaaacagtcacctgtgtgttctacatcattcagacagtcacatttacatgtgacagtggccttatggtttttcctgctttggaatagtcctcatgttttgtgtttgaaaaatttggtgttgcagtgaaatgctaaccattctactataacctttaccatccttcaaaacttctcatggggccaggcgcagtggctcgtgcctgtaatcccagcttagcgggactgaggcaagaggatcgcttgagcccgggagcttgagaccagcctgggcaagatggccagacctaatctttacaagaaaaaaaaattaatgtaaaaaaaatgaagtaaataattaaacttgtcacggatggcaggtagtgtatcagagtgcttgttatgtatgctcttcttggggggaggtggagttttttat

SEQ ID NO: 355563 - DNA, 2168 bp, Homo sapiens
gacttgggatgttttcttttccaaaaaatgcttggtgtccataggtttctaccttcttgaaaatagttttttaagccaattgtaaatatacgtattattgttaaaagtaactttaaactgcaacacatagcttcaaaacaatatagagattttgtaataccttataagtggagttggctaaaataccttatccatataaaacttattctattctttgcatgcttattttgtgtgttggttgctagcttaaagtttgatttgttgttactctttgtgtgccaaattcactaggcaagcggatttttcctcagacttcaaaaaataattcttttaagaaaaaatgtaaaaatgtttattctaaaaagctgcattaaagggacaacctataaaaagttttgctagctcatctttagaaggaagaaagaatattagcttgggtgatgtttaatttgggtggcgatagtttctgtaggctaaactttatgagaaaagtgtacctactctataaaggtaataaatgtaaaacctcttgctgttattgaggaagctcttcaactaccctaaatttcacaaatgtaacttataacactatgaaaagatttgaccaacaatttacgtttgctgtgtgctttagtttttgtttaagcatattcttttgcttgaatttctgtgttcatgagagttagggtgttttatgcttcttgaactaattttataacatatttaatatattaccagttaagatataaaatcatttgtacatagcgaattgtaaagcagctattaaagtaggtgaaataaagtatatatttgccggttatccatatcttttagaagtcctgacagaacaaccagtttatttgcacataggtagcttctgtttgaaggaaggtaaagttataaggaaactcaaatactataagatgtgtcaaggtatttctccagaattaattgcaaagctagtgctgaaggattttaatcagcttctaaaattttcttctcaataagacatatgttttgattacttagggaagattcctcatttttatttgccctttatgcatttaatccacatgataggacattaaaaattaatataaagaaaaatcgtgctcatactgtacatctatttctgtgcttggaactacttgttaatagtttttatcgaagctgtcagcaataagggacataaaactgctgtattatacattgtggaattgaataaacagcctaatttttttttttctagtatagggtacttaagcatttccacttttggaagaaaagtgtattagtattttatattgcatttcatttaaaaggacagtttttttttttttttgtaaatccattcattgaaatggtttctaaactgtataatgtaatttggagcctatttagtaatagaattaaatgtcctatgtagtgctacaatttttgaattagaaagtgatcaaatgtaagaaaaaaatttaaaaattcagcccagaaaacaaaatagtgtattaaattagtttaatgtaaaaggaatttataagatttttttcctcaatatagatacctcacttgaaaagaaagcacagcatacttaaagtagttctagtaaacatgtcctagaaaacagttgctaaatgtaggacatcttttgaggaattagtttatgagaaataaaattttacttgtttttactatcctgttagaagtatttgtttatcctgataattttaagccaacatagtagtcttaaattacttttgaatttctaatctgtgaaggcagtaaatgaaatatctgttctgcaactgttgaaacaaataattggctacattgaccataattaaagttaaaattttgccaatgatgtacagttttatggttaaagttgctgtggttggttgcattacatgacacagaaaactgtcctctacctcacgtgaaataaatattttatatggttttactaaaaataagactcatgtatctggtcacctagtttacaaattttgaattatatttattgaaacatgacatactgtgctctgagcttatacctcaattgtattttgtgctgttttccattttcatgccttgtaaataacttgtatagattgtggatcaaatactaaataaaaacttttaatgccaattaaatttgattcaagttattt

SEQ ID NO: 355564 - DNA, 2115 bp, Homo sapiens
gacttgggatgttttcttttccaaaaaatgcttggtgtccataggtttctaccttcttgaaaatagttttttaagccaattgtaaatatacgtattattgttaaaagtaactttaaactgcaacacatagcttcaaaacaatatagagattttgtaataccttataagtggagttggctaaaataccttatccatataaaacttattctattctttgcatgcttattttgtgtgttggttgctagcttaaagtttgatttgttgttactctttgtgtgccaaattcactaggcaagcggatttttcctcagacttcaaaaaataattcttttaagaaaaaatgtaaaaatgtttattctaaaaagctgcattaaagggacaacctataaaaagttttgctagctcatctttagaaggaagaaagaatattagcttgggtgatgtttaatttgggtggcgatagtttctgtaggctaaactttatgagaaaagtgtacctactctataaaggtaataaatgtaaaacctcttgctgttattgaggaagctcttcaactaccctaaatttcacaaatgtaacttataacactatgaaaagatttgaccaacaatttacgtttgctgtgtgctttagtttttgtttaagcatattcttttgcttgaatttctgtgttcatgagagttagggtgttttatgcttcttgaactaattttataacatatttaatatattaccagttaagatataaaatcatttgtacatagcgaattgtaaagcagctattaaagtaggtgaaataaagtatatatttgccggttatccatatcttttagaagtcctgacagaacaaccagtttatttgcacataggtagcttctgtttgaaggaaggtaaagttataaggaaactcaaatactataagatgtgtcaaggtatttctccagaattaattgcaaagctagtgctgaaggattttaatcagcttctaaaattttcttctcaataagacatatgttttgattacttagggaagattcctcatttttatttgccctttatgcatttaatccacatgataggacattaaaaattaatataaagaaaaatcgtgctcatactgtacatctatttctgtgcttggaactacttgttaatagtttttatcgaagctgtcagcaataagggacataaaactgctgtattatacattgtggaattgaataaacagcctaatttttttttttctagtatagggtacttaagcatttccacttttggaagaaaagtgtattagtattttatattgcatttcatttaaatgtataatgtaatttggagcctatttagtaatagaattaaatgtcctatgtagtgctacaatttttgaattagaaagtgatcaaatgtaagaaaaaaatttaaaaattcagcccagaaaacaaaatagtgtattaaattagtttaatgtaaaaggaatttataagatttttttcctcaatatagatacctcacttgaaaagaaagcacagcatacttaaagtagttctagtaaacatgtcctagaaaacagttgctaaatgtaggacatcttttgaggaattagtttatgagaaataaaattttacttgtttttactatcctgttagaagtatttgtttatcctgataattttaagccaacatagtagtcttaaattacttttgaatttctaatctgtgaaggcagtaaatgaaatatctgttctgcaactgttgaaacaaataattggctacattgaccataattaaagttaaaattttgccaatgatgtacagttttatggttaaagttgctgtggttggttgcattacatgacacagaaaactgtcctctacctcacgtgaaataaatattttatatggttttactaaaaataagactcatgtatctggtcacctagtttacaaattttgaattatatttattgaaacatgacatactgtgctctgagcttatacctcaattgtattttgtgctgttttccattttcatgccttgtaaataacttgtatagattgtggatcaaatactaaataaaaacttttaatgccaattaaatttgattcaagttattt

SEQ ID NO: 355565 - DNA, 1300 bp, Homo sapiens
  misc_feature (10)..(10): n is a, c, g, or t
cctcgtgaanttctggcacagaagacacgttataaggaaactcaaatactataagatgtgtcaaggtatttctccagaattaattgcaaagctagtgctgaaggattttaatcagcttctaaaattttcttctcaataagacatatgttttgattacttagggaagattcctcatttttatttgccctttatgcatttaatccacatgataggacattaaaaattaatataaagaaaaatcgtgctcatactgtacatctatttctgtgcttggaactacttgttaatagtttttatcgaagctgtcagcaataagggacataaaactgctgtattatacattgtggaattgaataaacagcctaatttttttttttctagtatagggtacttaagcatttccacttttggaagaaaagtgtattagtattttatattgcatttcatttaaaaggacagtttttttttttttttgtaaatccattcattgaaatggtttctaaactgtataatgtaatttggagcctatttagtaatagaattaaatgtcctatgtagtgctacaatttttgaattagaaagtgatcaaatgtaagaaaaaaatttaaaaattcagcccagaaaacaaaatagtgtattaaattagtttaatgtaaaaggaatttataagatttttttcctcaatatagatacctcacttgaaaagaaagcacagcatacttaaagtagttctagtaaacatgtcctagaaaacagttgctaaatgtaggacatcttttgaggaattagtttatgagaaataaaattttacttgtttttactatcctgttagaagtatttgtttatcctgataattttaagccaacatagtagtcttaaattacttttgaatttctaatctgtgaaggcagtaaatgaaatatctgttctgcaactgttgaaacaaataattggctacattgaccataattaaagttaaaattttgccaatgatgtacagttttatggttaaagttgctgtggttggttgcattacatgacacagaaaactgtcctctacctcacgtgaaataaatattttatatggttttactaaaaataagactcatgtatctggtcacctagtttacaaattttgaattatatttattgaaacatgacatactgtgctctgagcttatacctcaattgtattttgtgctgttttccattttcatgccttgtaaataacttgtatagattgtggatcaaatactaaataaaaacttttaatgccaattaaatttgattcaagttattt

SEQ ID NO: 355566 - DNA, 607 bp, Homo sapiens
ttcctttcccggtatgaagtataaagcgttgagtagttctagtaaacatgtcctagaaaacagttgctaaatgtaggacatcttttgaggaattagtttatgagaaataaaattttacttgtttttactatcctgttagaagtatttgtttatcctgataattttaagccaacatagtagtcttaaattacttttgaatttctaatctgtgaaggcagtaaatgaaatatctgttctgcaactgttgaaacaaataattggctacattgaccataattaaagttaaaattttgccaatgatgtacagttttatggttaaagttgctgtggttggttgcattacatgacacagaaaactgtcctctacctcacgtgaaataaatattttatatggttttactaaaaataagactcatgtatctggtcacctagtttacaaattttgaattatatttattgaaacatgacatactgtgctctgagcttatacctcaattgtattttgtgctgttttccattttcatgccttgtaaataacttgtatagattgtggatcaaatactaaataaaaacttttaatgccaattaaatttgattcaagttattt

SEQ ID NO: 355567 - DNA, 1703 bp, Homo sapiens
gacttgggatgttttcttttccaaaaaatgcttggtgtccataggtttctaccttcttgaaaatagttttttaagccaattgtaaatatacgtattattgttaaaagtaactttaaactgcaacacatagcttcaaaacaatatagagattttgtaataccttataagtggagttggctaaaataccttatccatataaaacttattctattctttgcatgcttattttgtgtgttggttgctagcttaaagtttgatttgttgttactctttgtgtgccaaattcactaggcaagcggatttttcctcagacttcaaaaaataattcttttaagaaaaaatgtaaaaatgtttattctaaaaagctgcattaaagggacaacctataaaaagttttgctagctcatctttagaaggaagaaagaatattagcttgggtgatgtttaatttgggtggcgatagtttctgtaggctaaactttatgagaaaagtgtacctactctataaaggtaataaatgtaaaacctcttgctgttattgaggaagctcttcaactaccctaaatttcacaaatgtaacttataacactatgaaaagatttgaccaacaatttacgtttgctgtgtgctttagtttttgtttaagcatattcttttgcttgaatttctgtgttcatgagagttagggtgttttatgcttcttgaactaattttataacatatttaatatattaccagttaagatataaaatcatttgtacatagcgaattgtaaagcagctattaaagtaggtgaaataaagtatatatttgccggttatccatatcttttagaagtcctgacagaacaaccagtttatttgcacataggtagcttctgtttgaaggaaggtaaagttataaggaaactcaaatactataagatgtgtcaaggtatttctccagaattaattgcaaagctagtgctgaaggattttaatcagcttctaaaattttcttctcaataagacatatgttttgattacttagggaagattcctcatttttatttgccctttatgcatttaatccacatgataggacattaaaaattaatataaagaaaaatcgtgctcatactgtacatctatttctgtgcttggaactacttgttaatagtttttatcgaagctgtcagcaataagggacataaaactgctgtattatacattgtggaattgaataaacagcctaatttttttttttctagtatagggtacttaagcatttccacttttggaagaaaagtgtattagtattttatattgcatttcatttaaaaggacagtttttttttttttttgtaaatccattcattgaaatggtttctaaactgtataatgtaatttggagcctatttagtaatagaattaaatgtcctatgtagtgctacaatttttgaattagaaagtgatcaaatgtaagaaaaaaatttaaaaattcagcccagaaaacaaaatagtgtattaaattagtttaatgtaaaaggaatttataagatttttttcctcaatatagatacctcacttgaaaagaaagcacagcatacttaaagtagttctagtaaacatgtcctagaaaacagttgctaaatgtaggacatcttttgagaatagtatgtatacttgatctattggagcagatgttgttgactgtgacatatg

SEQ ID NO: 355568 - DNA, 3521 bp, Homo sapiens
  misc_feature (123)..(123): n is a, c, g, or t
  misc_feature (129)..(129): n is a, c, g, or t
gaaagagacgaccaactgagaggtgggcccccaaagccggctgcgagagtcaccgaagatttccggagagccaaggagtcgggaagagccacttactgagcgttgccgaacgtgtacggaganagccgnagatgcggaaggcggggccacaagagcccttcctgcagggaacctcaggcttcagagagccgaaaagttgggaggcgtaaccacttacaggccggaagtgtccggggtggacgcattcgggtagccgaagaagtcccaggattgccgaagaagtcccaggatttccgaagcgagccgaagcatcgcgacagttttcagagacagctgatcggttggagctgttgcgccgagcagtcatggcggcggccagagctactacgccggccgatggcgaggagcccgccccggaggctgaggctctggccgcagcccgggagcggagcagccgcttcttgagcggcctggagctggtgaagcagggtgccgaggcgcgcgtgttccgtggccgcttccagggccgcgcggcggtgatcaagcaccgcttccccaagggctaccggcacccggcgctggaggcgcggcttggcagacggcggacggtgcaggaggcccgggcgctcctccgctgtcgccgcgctggaatatctgccccagttgtcttttttgtggactatgcttccaactgcttatatatggaagaaattgaaggctcagtgactgttcgagattatattcagtccactatggagactgaaaaaactccccagggtctctccaacttagccaagacaattgggcaggttttggctcgaatgcacgatgaagacctcattcatggtgatctcaccacctccaacatgctcctgaaaccccccctggaacagctgaacattgtgctcatagactttgggctgagtttcatttcagcacttccagaggataagggagtagacctctatgtcctggagaaggccttcctcagtacccatcccaacactgaaactgtgtttgaagcctttctgaagagctactccacctcctccaaaaaggccaggccagtgctaaaaaaattagatgaagtgcgcctgagaggaagaaagaggtccatggttgggtagaagaatgtgtatgacaaccacacacagtgaagctcttttttcaaagtaaatttgaagaaatgctacaagtatgagatgagatctaagtaaaggtgttaagatatttttaagtggtatgtgatcgtgtcattatcatctgcacttcactcaagagcttactatgtgtctaagtcatgttctaggcagaattgggtatttaaagtaaattgaggacaggcttctcccagattgtgacatgtatatctcagatacatgggtgtggcattgaaccacataatgagaacattattctctttttagtccttgtgagacaaggatgaagtctcagttgctgatactcgctgagcttactggccctctaacccagtgtttttttttgttgttgttgtgtacatgttatatttattttgaaaccagtttaatgggatacaaccagcattttaaaaaatgaaatagaatacagcatggaaaatatcagtgtattgttttatgaaactttcacgtgtatatatagaccaaggatatgtgctgagttttgatgtcaaatatatttctctttcagggtcatgatcaaaaaatgaaaagtctgcttaactccaatttctcttttaaaaaagcagacttacagctttcaggcaactgaaattcatgttaacatgtttttatttttattgctttgtatttttgtggttaccttctaagacaagtgattgatctaaagttccttttaagtttataccgctaaacaaactgagttgatttctatcacaggcagtaagtaggtagagcaaaaatggtgaagtgacttgtgaagactgaagtttgatgaagtctggtttaaggcacaggtaaactgagtgtggatgcaaaagtaccaggagctagcttttaaccttgcccagcctcagtttcttttcttagaagaagctatgtttgggtgggaagggaagagagggataagaaaatacctttcttccttgtaaactccaatcaacaaacatattttgagtgccttttgtgttccttggcaccctgttgggtattgggtacttggcaccctgttgggtattgggtacaatggtgagccagacagacacagcgcctgtccttttgtaagaatatttatttttataaaaaagtataaagtatacagtgggatgttttgatatacattatgaaatgattgctacagctgagctaattaacacccatcacctcacatagttactgtcttgtttcttaatatggacatttgcagctatgaatttccctctgcacactgttgtcatcacacactctcagttttggtattttgtgtttttgttttcattcatctcaaagtattttctaatttcccttgtgatttcttctttgaccccttgattgtttagaaatctgttaatttccacacatttgtaaatgttccaatttttcttttgttattgccagcttcattccattgtgttcagagatgatacagtcagtgcctgttcttatgaagcaaacattctataatagtaggaccagtaccctgtctgtttcattcaccacagtcagcatgccccaagtgcccagcatggggcggatggccaggaatgagtgaaaacttcccttcctgggtagttgtgactagtagagaggaaaaataatataattgcctgcttactgcatgccaggcattgggctgggaatttttatattggatctaaaataactcttaagttaggcattatccccattttatagatggagaaactggccccaaaaggtgggaacttgtccaagacgtcacaggtagcaagaggtacttttacctggctccaaatctgtgttctttccactgacaaatgagatatgggatatggtgcatctttacagtactataataagtattggcgtataacattattttcaaggaactccaagggccacaggagctgacaggtttttcaattaatattcccaacatgaatgagatgcctcattcctcagtttcctcacgtgtactataaggctagtacctgctttgttggggtatggttggctcgtgtgcattaagtcaacaaatccctagttgatagggtttggctgtgtccccatccaaatctcatcttgaattgttcccgtaatccccacgtgacatgggagggacccagtgggaggtaatttaatcctcggggcggctacctccgtgctgttctcgtgatagcgagtgagttctcacgagatctgatggttttataaggggcttttccctcttgttcggcacttcctgctgccacgtggagaagggtgtgtttgtttccccatctgccatgattataagttttctgaggcatccccagccatgctgaactgtgagttattaaacttttcctttataaattaaaaaat

SEQ ID NO: 355569 - DNA, 3467 bp, Homo sapiens
  misc_feature (123)..(123): n is a, c, g, or t
  misc_feature (129)..(129): n is a, c, g, or t
gaaagagacgaccaactgagaggtgggcccccaaagccggctgcgagagtcaccgaagatttccggagagccaaggagtcgggaagagccacttactgagcgttgccgaacgtgtacggaganagccgnagatgcggaaggcggggccacaagagcccttcctgcagggaacctcaggcttcagagagccgaaaagttgggaggcgtaaccacttacaggccggaagtgtccggggtggacgcattcgggtagccgaagaagtcccaggattgccgaagaagtcccaggatttccgaagcgagccgaagcatcgcgacagttttcagagacagctgatcggttggagctgttgcgccgagcagtcatggcggcggccagagctactacgccggccgatggcgaggagcccgccccggaggctgaggctctggccgcagcccgggagcggagcagccgcttcttgagcggcctggagctggtgaagcagggtgccgaggcgcgcgtgttccgtggccgcttccagggccgcgcggcggtgatcaagcaccgcttccccaagggctaccggcacccggcgctggaggcgcggcttggcagacggcggacggtgcaggaggcccgggcgctcctccgctgtcgccgcgctggaatatctgccccagttgtcttttttgtggactatgcttccaactgcttatatatggaagaaattgaaggctcagtgactgttcgagattatattcagtccactatggagactgaaaaaactccccagggtctctccaacttagccaagacaattgggcaggttttggctcgaatgcacgatgaagacctcattcatggtgatctcaccacctccaacatgctcctgaaaccccccctggaacagctgaacattgtgctcatagactttgggctgagtttcatttcagcacttccagaggataagggagtagacctctatgtcctggagaaggccttcctcagtacccatcccaacactgaaactgtgtttgaagcctttctgaagagctactccacctcctccaaaaaggccaggccagtgctaaaaaaattagatgaagtgcgcctgagaggaagaaagaggtccatggttgggtagaagaatgtgtatgacaaccacacacagtgaagctcttttttcaaagtaaatttgaagaaatgctacaagtatgagatgagatctaagtaaaggtgttaagatatttttaagtggtatgtgatcgtgtcattatcatctgcacttcactcaagagcttactatgtgtctaagtcatgttctaggcagaattgggtatttaaagtaaattgaggacaggcttctcccagattgtgacatgtatatctcagatacatgggtgtggcattgaaccacataatgagaacattattctctttttagtccttgtgagacaaggatgaagtctcagttgctgatactcgctgagcttactggccctctaacccagtgtttttttttgttgttgttgtgtacatgttatatttattttgaaaccagtttaatgggatacaaccagcattttaaaaaatgaaatagaatacagcatggaaaatatcagtgtattgttttatgaaactttcacgtgtatatatagaccaaggatatgtgctgagttttgatgtcaaatatatttctctttcagggtcatgatcaaaaaatgaaaagtctgcttaactccaatttctcttttaaaaaagcagacttacagctttcaggcaactgaaattcatgttaacatgtttttatttttattgctttgtatttttgtggttaccttctaagacaagtgattgatctaaagttccttttaagtttataccgctaaacaaactgagttgatttctatcacaggcagtaagtaggtagagcaaaaatggtgaagtgacttgtgaagactgaagtttgatgaagtctggtttaaggcacaggtaaactgagtgtggatgcaaaagtaccaggagctagcttttaaccttgcccagcctcagtttcttttcttagaagaagctatgtttgggtgggaagggaagagagggataagaaaatacctttcttccttgtaaactccaatcaacaaacatattttgagtgccttttgtgttccttggcaccctgttgggtattgggtacttggcaccctgttgggtattgggtacaatggtgagccagacagacacagcgcctgtccttttgtaagaatatttatttttataaaaaactgagctaattaacacccatcacctcacatagttactgtcttgtttcttaatatggacatttgcagctatgaatttccctctgcacactgttgtcatcacacactctcagttttggtattttgtgtttttgttttcattcatctcaaagtattttctaatttcccttgtgatttcttctttgaccccttgattgtttagaaatctgttaatttccacacatttgtaaatgttccaatttttcttttgttattgccagcttcattccattgtgttcagagatgatacagtcagtgcctgttcttatgaagcaaacattctataatagtaggaccagtaccctgtctgtttcattcaccacagtcagcatgccccaagtgcccagcatggggcggatggccaggaatgagtgaaaacttcccttcctgggtagttgtgactagtagagaggaaaaataatataattgcctgcttactgcatgccaggcattgggctgggaatttttatattggatctaaaataactcttaagttaggcattatccccattttatagatggagaaactggccccaaaaggtgggaacttgtccaagacgtcacaggtagcaagaggtacttttacctggctccaaatctgtgttctttccactgacaaatgagatatgggatatggtgcatctttacagtactataataagtattggcgtataacattattttcaaggaactccaagggccacaggagctgacaggtttttcaattaatattcccaacatgaatgagatgcctcattcctcagtttcctcacgtgtactataaggctagtacctgctttgttggggtatggttggctcgtgtgcattaagtcaacaaatccctagttgatagggtttggctgtgtccccatccaaatctcatcttgaattgttcccgtaatccccacgtgacatgggagggacccagtgggaggtaatttaatcctcggggcggctacctccgtgctgttctcgtgatagcgagtgagttctcacgagatctgatggttttataaggggcttttccctcttgttcggcacttcctgctgccacgtggagaagggtgtgtttgtttccccatctgccatgattataagttttctgaggcatccccagccatgctgaactgtgagttattaaacttttcctttataaattaaaaaat

SEQ ID NO: 355570 - DNA, 2972 bp, Homo sapiens
gtaaccgttcgtacgagaatcgctgtcctctccttgcggccgccagtgtggtggaattggtgcaggaggcccgggcgctcctccgctgtcgccgcgctggaatatctgccccagttgtcttttttgtggactatgcttccaactgcttatatatggaagaaattgaaggctcagtgactgttcgagattatattcagtccactatggagactgaaaaaactccccagggtctctccaacttagccaagacaattgggcaggttttggctcgaatgcacgatgaagacctcattcatggtgatctcaccacctccaacatgctcctgaaaccccccctggaacagctgaacattgtgctcatagactttgggctgagtttcatttcagcacttccagaggataagggagtagacctctatgtcctggagaaggccttcctcagtacccatcccaacactgaaactgtgtttgaagcctttctgaagagctactccacctcctccaaaaaggccaggccagtgctaaaaaaattagatgaagtgcgcctgagaggaagaaagaggtccatggttgggtagaagaatgtgtatgacaaccacacacagtgaagctcttttttcaaagtaaatttgaagaaatgctacaagtatgagatgagatctaagtaaaggtgttaagatatttttaagtggtatgtgatcgtgtcattatcatctgcacttcactcaagagcttactatgtgtctaagtcatgttctaggcagaattgggtatttaaagtaaattgaggacaggcttctcccagattgtgacatgtatatctcagatacatgggtgtggcattgaaccacataatgagaacattattctctttttagtccttgtgagacaaggatgaagtctcagttgctgatactcgctgagcttactggccctctaacccagtgtttttttttgttgttgttgtgtacatgttatatttattttgaaaccagtttaatgggatacaaccagcattttaaaaaatgaaatagaatacagcatggaaaatatcagtgtattgttttatgaaactttcacgtgtatatatagaccaaggatatgtgctgagttttgatgtcaaatatatttctctttcagggtcatgatcaaaaaatgaaaagtctgcttaactccaatttctcttttaaaaaagcagacttacagctttcaggcaactgaaattcatgttaacatgtttttatttttattgctttgtatttttgtggttaccttctaagacaagtgattgatctaaagttccttttaagtttataccgctaaacaaactgagttgatttctatcacaggcagtaagtaggtagagcaaaaatggtgaagtgacttgtgaagactgaagtttgatgaagtctggtttaaggcacaggtaaactgagtgtggatgcaaaagtaccaggagctagcttttaaccttgcccagcctcagtttcttttcttagaagaagctatgtttgggtgggaagggaagagagggataagaaaatacctttcttccttgtaaactccaatcaacaaacatattttgagtgccttttgtgttccttggcaccctgttgggtattgggtacttggcaccctgttgggtattgggtacaatggtgagccagacagacacagcgcctgtccttttgtaagaatatttatttttataaaaaagtataaagtatacagtgggatgttttgatatacattatgaaatgattgctacagctgagctaattaacacccatcacctcacatagttactgtcttgtttcttaatatggacatttgcagctatgaatttccctctgcacactgttgtcatcacacactctcagttttggtattttgtgtttttgttttcattcatctcaaagtattttctaatttcccttgtgatttcttctttgaccccttgattgtttagaaatctgttaatttccacacatttgtaaatgttccaatttttcttttgttattgccagcttcattccattgtgttcagagatgatacagtcagtgcctgttcttatgaagcaaacattctataatagtaggaccagtaccctgtctgtttcattcaccacagtcagcatgccccaagtgcccagcatggggcggatggccaggaatgagtgaaaacttcccttcctgggtagttgtgactagtagagaggaaaaataatataattgcctgcttactgcatgccaggcattgggctgggaatttttatattggatctaaaataactcttaagttaggcattatccccattttatagatggagaaactggccccaaaaggtgggaacttgtccaagacgtcacaggtagcaagaggtacttttacctggctccaaatctgtgttctttccactgacaaatgagatatgggatatggtgcatctttacagtactataataagtattggcgtataacattattttcaaggaactccaagggccacaggagctgacaggtttttcaattaatattcccaacatgaatgagatgcctcattcctcagtttcctcacgtgtactataaggctagtacctgctttgttggggtatggttggctcgtgtgcattaagtcaacaaatccctagttgatagggtttggctgtgtccccatccaaatctcatcttgaattgttcccgtaatccccacgtgacatgggagggacccagtgggaggtaatttaatcctcggggcggctacctccgtgctgttctcgtgatagcgagtgagttctcacgagatctgatggttttataaggggcttttccctcttgttcggcacttcctgctgccacgtggagaagggtgtgtttgtttccccatctgccatgattataagttttctgaggcatccccagccatgctgaactgtgagttattaaacttttcctttataaattaaaaaat

SEQ ID NO: 355571 - DNA, 1232 bp, Homo sapiens
  misc_feature (123)..(123): n is a, c, g, or t
  misc_feature (129)..(129): n is a, c, g, or t
gaaagagacgaccaactgagaggtgggcccccaaagccggctgcgagagtcaccgaagatttccggagagccaaggagtcgggaagagccacttactgagcgttgccgaacgtgtacggaganagccgnagatgcggaaggcggggccacaagagcccttcctgcagggaacctcaggcttcagagagccgaaaagttgggaggcgtaaccacttacaggccggaagtgtccggggtggacgcattcgggtagccgaagaagtcccaggattgccgaagaagtcccaggatttccgaagcgagccgaagcatcgcgacagttttcagagacagctgatcggttggagctgttgcgccgagcagtcatggcggcggccagagctactacgccggccgatggcgaggagcccgccccggaggctgaggctctggccgcagcccgggagcggagcagccgcttcttgagcggcctggagctggtgaagcagggtgccgaggcgcgcgtgttccgtggccgcttccagggccgcgcggcggtgatcaagcaccgcttccccaagggctaccggcacccggcgctggaggcgcggcttggcagacggcggacggtgcaggaggcccgggcgctcctccgctgtcgccgcgctggaatatctgccccagttgtcttttttgtggactatgcttccaactgcttatatatggaagaaattgaaggctcagtgactgttcgagattatattcagtccactatggagactgaaaaaactccccagggtctctccaacttagccaagacaattgggcaggttttggctcgaatgcacgatgaagacctcattcatggtgatctcaccacctccaacatgctcctgaaaccccccctggaacagctgaacattgtgctcatagactttgggctgagtttcatttcagcacttccagaggataagggagtagacctctatgtcctggagaaggccttcctcagtacccatcccaacactgaaactgtgtttgaagcctttctgaagagctactccacctcctccaaaaaggccaggccagtgctaaaaaaattagatgaagtgcgcctgagaggaagaaagaggtccatggttgggtagaagaatgtgtatgacaaccacacacagtgaagctcttttttcaaagtaaatttgaagaaatgctacaagtatgagatgagatctaagtaaaggtgttaagatatt

SEQ ID NO: 355572 - DNA, 3496 bp, Homo sapiens
  misc_feature (123)..(123): n is a, c, g, or t
  misc_feature (129)..(129): n is a, c, g, or t
gaaagagacgaccaactgagaggtgggcccccaaagccggctgcgagagtcaccgaagatttccggagagccaaggagtcgggaagagccacttactgagcgttgccgaacgtgtacggaganagccgnagatgcggaaggcggggccacaagagcccttcctgcagggaacctcaggcttcagagagccgaaaagttgggaggcgtaaccacttacaggccggaagtgtccggggtggacgcattcgggtagccgaagaagtcccaggattgccgaagaagtcccaggatttccgaagcgagccgaagcatcgcgacagttttcagagacagctgatcggttggagctgttgcgccgagcagtcatggcggcggccagagctactacgccggccgatggcgaggagcccgccccggaggctgaggctctggccgcagcccgggagcggagcagccgcttcttgagcggcctggagctggtgaagcagggtgccgaggcgcgcgtgttccgtggccgcttccagggccgcgcggcggtgatcaagcaccgcttccccaagggctaccggcacccggcgctggaggcgcggcttggcagacggcggacggtgcaggaggcccgggcgctcctccgctgtcgccgcgctggaatatctgccccagttgtcttttttgtggactatgcttccaactgcttatatatggaagaaattgaaggctcagtgactgttcgagattatattcagtccactatggagactgaaaaaactccccagggtctctccaacttagccaagacaattgggcaggttttggctcgaatgcacgatgaagacctcattcatggtgatctcaccacctccaacatgctcctgaaaccccccctggaacagctgaacattgtgctcatagactttgggctgagtttcatttcagcacttccagaggataagggagtagacctctatgtcctggagaaggccttcctcagtacccatcccaacactgaaactgtgtttgaagcctttctgaagagctactccacctcctccaaaaaggccaggccagtgctaaaaaaattagatgaagtgcgcctgagaggaagaaagaggtccatggttgggtagaagaatgtgtatgacaaccacacacagtgaagctcttttttcaaagtaaatttgaagaaatgctacaagtatgagatgagatctaagtaaaggtgttaagatatttttaagtggtatgtgatcgtgtcattatcatctgcacttcactcaagagcttactatgtgtctaagtcatgttctaggcagaattgggtatttaaagtaaattgaggacaggcttctcccagattgtgacatgtatatctcagatacatgggtgtggcattgaaccacataatgagaacattattctctttttagtccttgtgagacaaggatgaagtctcagttgctgatactcgctgagcttactggccctctaacccagtgtttttttttgttgttgttgtgtacatgttatatttattttgaaaccagtttaatgggatacaaccagcattttaaaaaatgaaatagaatacagcatggaaaatatcagtgtattgttttatgaaactttcacgtgtatatatagaccaaggatatgtgctgagttttgatgtcaaatatatttctctttcagggtcatgatcaaaaaatgaaaagtctgcttaactccaatttctcttttaaaaaagcagacttacagctttcaggcaactgaaattcatgttaacatgtttttatttttattgctttgtatttttgtggttaccttctaagacaagtgattgatctaaagttccttttaagtttataccgctaaacaaactgagttgatttctatcacaggcagtaagtaggtagagcaaaaatggtgaagtgacttgtgaagactgaagtttgatgaagtctggtttaaggcacaggtaaactgagtgtggatgcaaaagtaccaggagctagcttttaaccttgcccagcctcagtttcttttcttagaagaagctatgtttgggtgggaagggaagagagggataagaaaatacctttcttccttgtaaactccaatcaacaaacatattttgagtgccttttgtgttccttggcacccctgttgggtattgggtacaatggtgagccagacagacacagcgcctgtccttttgtaagaatatttatttttataaaaaagtataaagtatacagtgggatgttttgatatacattatgaaatgattgctacagctgagctaattaacacccatcacctcacatagttactgtcttgtttcttaatatggacatttgcagctatgaatttccctctgcacactgttgtcatcacacactctcagttttggtattttgtgtttttgttttcattcatctcaaagtattttctaatttcccttgtgatttcttctttgaccccttgattgtttagaaatctgttaatttccacacatttgtaaatgttccaatttttcttttgttattgccagcttcattccattgtgttcagagatgatacagtcagtgcctgttcttatgaagcaaacattctataatagtaggaccagtaccctgtctgtttcattcaccacagtcagcatgccccaagtgcccagcatggggcggatggccaggaatgagtgaaaacttcccttcctgggtagttgtgactagtagagaggaaaaataatataattgcctgcttactgcatgccaggcattgggctgggaatttttatattggatctaaaataactcttaagttaggcattatccccattttatagatggagaaactggccccaaaaggtgggaacttgtccaagacgtcacaggtagcaagaggtacttttacctggctccaaatctgtgttctttccactgacaaatgagatatgggatatggtgcatctttacagtactataataagtattggcgtataacattattttcaaggaactccaagggccacaggagctgacaggtttttcaattaatattcccaacatgaatgagatgcctcattcctcagtttcctcacgtgtactataaggctagtacctgctttgttggggtatggttggctcgtgtgcattaagtcaacaaatccctagttgatagggtttggctgtgtccccatccaaatctcatcttgaattgttcccgtaatccccacgtgacatgggagggacccagtgggaggtaatttaatcctcggggcggctacctccgtgctgttctcgtgatagcgagtgagttctcacgagatctgatggttttataaggggcttttccctcttgttcggcacttcctgctgccacgtggagaagggtgtgtttgtttccccatctgccatgattataagttttctgaggcatccccagccatgctgaactgtgagttattaaacttttcctttataaattaaaaaat

SEQ ID NO: 355573 - DNA, 3467 bp, Homo sapiens
  misc_feature (123)..(123): n is a, c, g, or t
  misc_feature (129)..(129): n is a, c, g, or t
gaaagagacgaccaactgagaggtgggcccccaaagccggctgcgagagtcaccgaagatttccggagagccaaggagtcgggaagagccacttactgagcgttgccgaacgtgtacggaganagccgnagatgcggaaggcggggccacaagagcccttcctgcagggaacctcaggcttcagagagccgaaaagttgggaggcgtaaccacttacaggccggaagtgtccggggtggacgcattcgggtagccgaagaagtcccaggattgccgaagaagtcccaggatttccgaagcgagccgaagcatcgcgacagttttcagagacagctgatcggttggagctgttgcgccgagcagtcatggcggcggccagagctactacgccggccgatggcgaggagcccgccccggaggctgaggctctggccgcagcccgggagcggagcagccgcttcttgagcggcctggagctggtgaagcagggtgccgaggcgcgcgtgttccgtggccgcttccagggccgcgcggcggtgatcaagcaccgcttccccaagggctaccggcacccggcgctggaggcgcggcttggcagacggcggacggtgcaggaggcccgggcgctcctccgctgtcgccgcgctggaatatctgccccagttgtcttttttgtggactatgcttccaactgcttatatatggaagaaattgaaggctcagtgactgttcgagattatattcagtccactatggagactgaacgaatgcacgatgaagacctcattcatggtgatctcaccacctccaacatgctcctgaaaccccccctggaacagctgaacattgtgctcatagactttgggctgagtttcatttcagcacttccagaggataagggagtagacctctatgtcctggagaaggccttcctcagtacccatcccaacactgaaactgtgtttgaagcctttctgaagagctactccacctcctccaaaaaggccaggccagtgctaaaaaaattagatgaagtgcgcctgagaggaagaaagaggtccatggttgggtagaagaatgtgtatgacaaccacacacagtgaagctcttttttcaaagtaaatttgaagaaatgctacaagtatgagatgagatctaagtaaaggtgttaagatatttttaagtggtatgtgatcgtgtcattatcatctgcacttcactcaagagcttactatgtgtctaagtcatgttctaggcagaattgggtatttaaagtaaattgaggacaggcttctcccagattgtgacatgtatatctcagatacatgggtgtggcattgaaccacataatgagaacattattctctttttagtccttgtgagacaaggatgaagtctcagttgctgatactcgctgagcttactggccctctaacccagtgtttttttttgttgttgttgtgtacatgttatatttattttgaaaccagtttaatgggatacaaccagcattttaaaaaatgaaatagaatacagcatggaaaatatcagtgtattgttttatgaaactttcacgtgtatatatagaccaaggatatgtgctgagttttgatgtcaaatatatttctctttcagggtcatgatcaaaaaatgaaaagtctgcttaactccaatttctcttttaaaaaagcagacttacagctttcaggcaactgaaattcatgttaacatgtttttatttttattgctttgtatttttgtggttaccttctaagacaagtgattgatctaaagttccttttaagtttataccgctaaacaaactgagttgatttctatcacaggcagtaagtaggtagagcaaaaatggtgaagtgacttgtgaagactgaagtttgatgaagtctggtttaaggcacaggtaaactgagtgtggatgcaaaagtaccaggagctagcttttaaccttgcccagcctcagtttcttttcttagaagaagctatgtttgggtgggaagggaagagagggataagaaaatacctttcttccttgtaaactccaatcaacaaacatattttgagtgccttttgtgttccttggcaccctgttgggtattgggtacttggcaccctgttgggtattgggtacaatggtgagccagacagacacagcgcctgtccttttgtaagaatatttatttttataaaaaagtataaagtatacagtgggatgttttgatatacattatgaaatgattgctacagctgagctaattaacacccatcacctcacatagttactgtcttgtttcttaatatggacatttgcagctatgaatttccctctgcacactgttgtcatcacacactctcagttttggtattttgtgtttttgttttcattcatctcaaagtattttctaatttcccttgtgatttcttctttgaccccttgattgtttagaaatctgttaatttccacacatttgtaaatgttccaatttttcttttgttattgccagcttcattccattgtgttcagagatgatacagtcagtgcctgttcttatgaagcaaacattctataatagtaggaccagtaccctgtctgtttcattcaccacagtcagcatgccccaagtgcccagcatggggcggatggccaggaatgagtgaaaacttcccttcctgggtagttgtgactagtagagaggaaaaataatataattgcctgcttactgcatgccaggcattgggctgggaatttttatattggatctaaaataactcttaagttaggcattatccccattttatagatggagaaactggccccaaaaggtgggaacttgtccaagacgtcacaggtagcaagaggtacttttacctggctccaaatctgtgttctttccactgacaaatgagatatgggatatggtgcatctttacagtactataataagtattggcgtataacattattttcaaggaactccaagggccacaggagctgacaggtttttcaattaatattcccaacatgaatgagatgcctcattcctcagtttcctcacgtgtactataaggctagtacctgctttgttggggtatggttggctcgtgtgcattaagtcaacaaatccctagttgatagggtttggctgtgtccccatccaaatctcatcttgaattgttcccgtaatccccacgtgacatgggagggacccagtgggaggtaatttaatcctcggggcggctacctccgtgctgttctcgtgatagcgagtgagttctcacgagatctgatggttttataaggggcttttccctcttgttcggcacttcctgctgccacgtggagaagggtgtgtttgtttccccatctgccatgattataagttttctgaggcatccccagccatgctgaactgtgagttattaaacttttcctttataaattaaaaaat

SEQ ID NO: 355574 - DNA, 1110 bp, Homo sapiens
gcgtgggcagggggcgggcccgggagttggaacagagggcacagacggcccctcctcggaggggagggaccggagccggggcctttttctttaagactcgcagcactggatcccagaacttagtctgcgcggcggcattgacactagctgggctcctcggggcgcgccccaggtggtccgaagcccggtccgccctccacgcaggtgccccgcgctccccgctcagccatgtcgtcctgcagccgcgtggcgctggtgaccggggccaacaggggcatcggcttggccatcgcgcgcgaactgtgccgacagttctctggggatgtggtgctcaccgcgcgggacgtggcgcggggccaggcggccgtgcagcagctgcaggcggagggcctgagcccgcgcttccaccaactggacatcgacgacttgcagagcatccgcgccctgcgcgacttcctgcgcaaggagtacggggggctcaatgtactggtcaacaacgcggccgtcgccttcaagagtgatgatccaatgccctttgacattaaagctgagatgacactgaagacaaatttttttgccactagaaacatgtgcaacgagttactgccgataatgaaacctcatgggagagtggtgaatatcagtagtttgcagtgtttaagggcttttgaaaactgcagtgaagatctgcaggaaaggttccacagtgagacactcacagaaggagacctggtggatctcatgaaaaagtttgtggaggacacaaaaaatgaggtgcatgagagggaaggctggcccaactcaccttatggggtgtccaagttgggggtcacggtcttatcgaggatcctggccaggcgtctggatgagaagaggaaagctgacaggattctggtgaatgcgtgctgcccaggaccagtgaagacagacatggatgggaaagacagcatcaggactgtggaggagggggctgagacccctgtctacttggccctcttgcctccagatgccactgagccacaaggccagttggtccatgacaaagttgtgcaaaactggtaaacgtctgcttcggagcttgctgcttaataaatgttggtggaatgaatg

SEQ ID NO: 355575 - DNA, 1161 bp, Homo sapiens
gcgtgggcagggggcgggcccgggagttggaacagagggcacagacggcccctcctcggaggggagggaccggagccggggcctttttctttaagactcgcagcactggatcccagaacttagtctgcgcggcggcattgacactagctgggctcctcggggcgcgccccaggtggtccgaagcccggtccgccctccacgcaggtgccccgcgctccccgctcagccatgtcgtcctgcagccgcgtggcgctggtgaccggggccaacaggggcatcggcttggccatcgcgcgcgaactgtgccgacagttctctggggatgtggtgctcaccgcgcgggacgtggcgcggggccaggcggccgtgcagcagctgcaggcggagggcctgagcccgcgcttccaccaactggacatcgacgacttgcagagcatccgcgccctgcgcgacttcctgcgcaaggagtacggggggctcaatgtactggtcaacaacgcggccgtcgccttcaagagtgatgatccaatgccctttgacattaaagctgagatgacactgaagacaaatttttttgccactagaaacatgtgcaacgagttactgccgataatgaaacctcatgggagagtggtgaatatcagtagtttgcagtgtttaagggcttttgaaaactgcagtgaagatctgcaggaaaggttccacagtgagacactcacagaaggagacctggtggatctcatgaaaaagtttgtggaggacacaaaaaatgaggtgcatgagagggaaggctggcccaactcaccttatggggtgtccaagttgggggtcacggtcttatcgaggatcctggccaggcgtctggatgagaagaggaaagctgacaggattctggtgaatgcgtgctgcccaggaccagtgaagacagacatggatgggaaagacagcatcaggactgtggaggagggggctgagacccctgtctacttggccctcttgcctccagatgccactgagccacaaggccagttggtccatgacaaagttgtgcaaaactggtaaacgtctgcttcggagcttgctgcttaataaatgttggtggaatgaatgaatgaattgatgctgtggtttgattatttctgttctttttttttttgagac

SEQ ID NO: 355576 - DNA, 669 bp, Homo sapiens
gcgtgggcagggggcgggcccgggagttggaacagagggcacagacggcccctcctcggaggggagggaccggagccggggcctttttctttaagactcgcagcactggatcccagaacttagtctgcgcggcggcattgacactagctgggctcctcggggcgcgccccaggtggtccgaagcccggtccgccctccacgcaggtgccccgcgctccccgctcagccatgtcgtcctgcagccgcgtggcgctggtgaccggggccaacaggggcatcggcttggccatcgcgcgcgaactgtgccgacagttctctggggatgtggtgctcaccgcgcgggacgtggcgcggggccaggcggccgtgcagcagctgcaggcggagggcctgagcccgcgcttccaccaactggacatcgacgacttgcagagcatccgcgccctgcgcgacttcctgcgcaaggagtacggggggctcaatgtactggtcaacaacgcggccgtcgccttcaagagtgatgatccaatgccctttgacattaaagctgagatgacactgaagacaaatttttttgccactagaaacatgtgcaacgagttactgccgataatgaaacctcatggtaagcccaacgtgtggacagtcgggttgcatccctcagtaaga

SEQ ID NO: 355577 - DNA, 147 bp, Homo sapiens
caaatcaggtgaaataaaggcaagccttttgtgttagtccttcagagagccactcaccaggtcaaaacaatacaattctttgagagcagagtctactctgttatctccagcaccagtaacccactctgggaattactgccaccgagc

SEQ ID NO: 355578 - DNA, 7484 bp, Homo sapiens
ctgacagtgttccggagccggggcgagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgagtgaaacccaatggaaaaagcatgacatttagaagtagaagacttagcttcaaatccctactccttcacttactaattttgtgatttggaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaatttt

SEQ ID NO: 355579 - DNA, 7279 bp, Homo sapiens
atctgacagtgttccggagccggccgacgggtctggcccagcctggcgcctgagtgaaacccaatggaaaaagcatgacatttagaagtagaagacttagcttcaaatccctactccttcacttactaattttgtgatttggaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagataacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaatttt

SEQ ID NO: 355580 - DNA, 7347 bp, Homo sapiens
ctgacagtgttccggagccggggcgagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgagtgaaacccaatggaaaaagcatgacatttagaagtagaagacttagcttcaaatccctactccttcacttactaattttgtgatttggaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagataacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaatttt

SEQ ID NO: 355581 - DNA, 6935 bp, Homo sapiens
atctgacagtgttccggagccggccgacgggtctggcccagcctggcgcctgagtgaaacccaatggaaaaagcatgacatttagaagtagaagacttagcttcaaatccctactccttcacttactaattttgtgatttggaaatatccgcgcaagatgttgacgttgcagacttggctagtgcaagccttgtttattttcctcaccactgaatctacagggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaatttt

SEQ ID NO: 355582 - DNA, 7569 bp, Homo sapiens
ctgacagtgttccggagccggggcgagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgagtgaaacccaatggaaaaagcatgacatttagaagtagaagacttagcttcaaatccctactccttcacttactaattttgtgatttggaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgtctcatggatccattatggcttcttcacatggcttgagtcttgccaacgaggaccttacagcttagttgaagaaattttgcataactcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaatttt

SEQ ID NO: 355583 - DNA, 5291 bp, Homo sapiens
agttggaacgccggcaggtcccggtccggaaattccggggcaccatactactaataaattcgcggccgcgtcgacgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaatttt

SEQ ID NO: 355584 - DNA, 3068 bp, Homo sapiens
ggaaactgaatatatcagaatgaaacatctatttttttcataaagaagatcatataatatgtgaaagaactttgaaaggatgaggcattatataaatgcaagaatataaaagagaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaatttt

SEQ ID NO: 355585 - DNA, 7430 bp, Homo sapiens
ctgacagtgttccggagccggggcgagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgagtgaaacccaatggaaaaagcatgacatttagaagtagaagacttagcttcaaatccctactccttcacttactaattttgtgatttggaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaatttt

SEQ ID NO: 355586 - DNA, 2336 bp, Homo sapiens
ggtactgttacgtgcttgagggccatttttggcttaggctgaggttgttaggttttcactgttaatgagaacccaagttagattgtcccaatgagagatttaaatctctcattgcatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaatttt

SEQ ID NO: 355587 - DNA, 7047 bp, Homo sapiens
  misc_feature (7036)..(7036): n is a, c, g, or t
ctgacagtgttccggagccggggcgagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgagtgaaacccaatggaaaaagcatgacatttagaagtagaagacttagcttcaaatccctactccttcacttactaattttgtgatttggaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgatgcgtccgtcgangttggtccagg

SEQ ID NO: 355588 - DNA, 6853 bp, Homo sapiens
ctgacagtgttccggagccggggcgagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgagtgaaacccaatggaaaaagcatgacatttagaagtagaagacttagcttcaaatccctactccttcacttactaattttgtgatttggaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcgtactagttatgtgcgtactagttatgtgcgtactagttatgtgcgtactagttatgtgcgtactagttatgtgcgtactagttatgtgcgtactatgcttatgtgcgt

SEQ ID NO: 355589 - DNA, 326 bp, Homo sapiens
aatcccttaagtaaattttaagaaataaatacttgttcaaattttttttctgtatgtggttactatcatctgactatgcatatttgtaacagcatttatcattagtggtgttagctaaataagcatcttagtgtaaatgagatgcttcgtgtgggttttgtgacattttaaatgacataatggaatgtgatttaaaagaaaaccagtacactatcttggtcttaataacatagaatggagatggcaaatttatccactagttttccagatttactatttaatagctgaggtctgaaatcgtagcatcctccctcctagtggacatt

SEQ ID NO: 355590 - DNA, 216 bp, Homo sapiens
tagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatcta

SEQ ID NO: 355591 - DNA, 7401 bp, Homo sapiens
ctgacagtgttccggagccggggcgagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgagtgaaacccaatggaaaaagcatgacatttagaagtagaagacttagcttcaaatccctactccttcacttactaattttgtgatttggaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagataacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaatttt

SEQ ID NO: 355592 - DNA, 7430 bp, Homo sapiens
ctgacagtgttccggagccggggcgagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgagtgaaacccaatggaaaaagcatgacatttagaagtagaagacttagcttcaaatccctactccttcacttactaattttgtgatttggaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaatttt

SEQ ID NO: 355593 - DNA, 6677 bp, Homo sapiens
  misc_feature (7)..(7): n is a, c, g, or t
  misc_feature (25)..(25): n is a, c, g, or t
  misc_feature (41)..(41): n is a, c, g, or t
  misc_feature (63)..(63): n is a, c, g, or t
taggtanttataaacgactcgttanatcacttggtgtcatncaattttaagatactagacagntcctctgagttgatcactgataaattatgtggcggattgggcttcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaatttt

SEQ ID NO: 355594 - DNA, 7431 bp, Homo sapiens
ctgacagtgttccggagccggggcgagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgagtgaaacccaatggaaaaagcatgacatttagaagtagaagacttagcttcaaatccctactccttcacttactaattttgtgatttggaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaatttt

SEQ ID NO: 355595 - DNA, 7477 bp, Homo sapiens
  misc_feature (7476)..(7477): n is a, c, g, or t
ctgacagtgttccggagccggggcgagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgagtgaaacccaatggaaaaagcatgacatttagaagtagaagacttagcttcaaatccctactccttcacttactaattttgtgatttggaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttatgtgactactccctgtgtttaatgtctatatatagtctatccttagaatttagctatctgtccttacaaaccaacatcgggcggccatccttgaggtcgcggcaaggggacagccaattacctcggtgccctcctggttgttgtnn

SEQ ID NO: 355596 - DNA, 7113 bp, Homo sapiens
  misc_feature (7108)..(7108): n is a, c, g, or t
ctgacagtgttccggagccggggcgagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgagtgaaacccaatggaaaaagcatgacatttagaagtagaagacttagcttcaaatccctactccttcacttactaattttgtgatttggaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgtttcaatccagagtgctgtttcaaaccaggggatcctctagagcgaccgcaggcagcanaaagc

SEQ ID NO: 355597 - DNA, 5808 bp, Homo sapiens
ctgacagtgttccggagccggggcgagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgagtgaaacccaatggaaaaagcatgacatttagaagtagaagacttagcttcaaatccctactccttcacttactaattttgtgatttggaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaaggcatcaccatcaatggccattagagctccaatagtcttagctctttcgtacgcgttagaccgtcccgtttagtaacagatatacac

SEQ ID NO: 355598 - DNA, 393 bp, Homo sapiens
gtattaagtgtttcacaagaaatactcctttacacgtatgtgattatagcttgggggaacaatcaaggataaatgacagtttcttttctttctttctttctttctttctttcttttctttctttggcattattgtgagagggaacaattttataagtaaatgtttttactccaaacatgagtaaactgttcaagctaagggctttactgacttacttccttcatgggtttgtctggttcatcttattcccttgtcatctatttctcctgatgacttttttccacttataaattgaaatatagttccacacccatgacacaattatttctgtaactttggcccagtttcctaacccagagacatttttctcttcagtgagtgctgtaaattaaa

SEQ ID NO: 355599 - DNA, 1085 bp, Homo sapiens
tgtgggcgtccgtcgtggtcttctgatgacgcagttagtcggctgcaatggcgccggtgaggcggtccgcgaagtggcggcctggtggtattgaggcgcgtggtgaaggggtttccactgtcgggtacaggaataagaatgtgagacagaagacatggcggcctaaccacccgcaagccttcgtggggagcgttcgcgagggacaaggctttgcttttcgaagaaaactgaaaatacagcaaagttacaagaaattgctacggaaggaaaagaaggctcaaacgtcactggaatctcaattcacagatcgatacccagataatctgaaacatctctatttagctgaagaggaaagacataggaagcaagcaagaaaagtcgaccatcctttgtcagaacaagttcaccagccgttgcttgaagaacagtgtagcattgacgagcctttatttgaagatcagtgtagctttgaccagcctcagccagaagaacaatgtattaaaacagtaaactcctttacaattccaaagaaaaataaaaagaaaacatcaaatcaaaaagcacaagaagaatatgaacagatacaagccaaacgtgctgctaagaaacaagaattcgagaggagaaaacaggagagagaagaagcccaaaggcagtacaaaaagaagaaaatggaagtgtttaaaatactgaacaaaaagactaaaaagggccaaccaaacttgaatgtacaaatggagtaccttcttcaaaaaatacaagaaaaatgttaaacattttgttcctacaggttaaaatatctgctgcctattaggttcttctgtgacatgtgcctcccagcagtgaactaaatttgtcgacataaactggattgctaaactatgctaaatataagatgttcacatatttttattatggtaaaaaattttctaaatatgttctacatgtttcttatttatttgcctctgaaggaaggttggcctgaagaactgaaagaacctcttattttgcaagacaggcccaagcatgtaatacttttgtaccatatgagatttatatgaaataaattttttaaaaataaggaa

SEQ ID NO: 355600 - DNA, 542 bp, Homo sapiens
tgtgggcgtccgtcgtggtcttctgatgacgcagttagtcggctgcaatggcgccggtgaggcggtccgcgaagtggcggcctggtggtattgaggcgcgtggtgaaggggtttccactgtcgggtacaggaataagaatgtgagacagaagacatggcggcctaaccacccgcaagccttcgtggggagcgttcgcgagggacaaggctttgcttttcgaagaaaactgaaaatacagcaaagttacaagaaattgctacggaaggaaaagaaggctcaaacgtcactggaatctcaattcacagatcgatacccagataatctgaaacatctctatttagctgaagaggaaagacataggaagcaagcaagaaaagtcgaccatcctttgtcagaacaagttcaccagccgttgcttgaagaacagtgtagcattgacgagcctttatttgaagatcagtgtagctttgaccagcctcagccagaagaacaatgtattaaaacagtaaagtatgtattttcttcatttgaaatcctttaa

SEQ ID NO: 355601 - DNA, 1001 bp, Homo sapiens
cgcgtctctgagggcagggcctccgtctccgacgctgacttcctcagcgcagccagcactgtctccggtggcaagtcgaccagctcctcccacacggattctgtgtagaaatccacggacaaggctttgcttttcgaagaaaactgaaaatacagcaaagttacaagaaattgctacggaaggaaaagaaggctcaaacgtcactggaatctcaattcacagatcgatacccagataatctgaaacatctctatttagctgaagaggaaagacataggaagcaagcaagaaaagtcgaccatcctttgtcagaacaagttcaccagccgttgcttgaagaacagtgtagcattgacgagcctttatttgaagatcagtgtagctttgaccagcctcagccagaagaacaatgtattaaaacagtaaactcctttacaattccaaagaaaaataaaaagaaaacatcaaatcaaaaagcacaagaagaatatgaacagatacaagccaaacgtgctgctaagaaacaagaattcgagaggagaaaacaggagagagaagaagcccaaaggcagtacaaaaagaagaaaatggaagtgtttaaaatactgaacaaaaagactaaaaagggccaaccaaacttgaatgtacaaatggagtaccttcttcaaaaaatacaagaaaaatgttaaacattttgttcctacaggttaaaatatctgctgcctattaggttcttctgtgacatgtgcctcccagcagtgaactaaatttgtcgacataaactggattgctaaactatgctaaatataagatgttcacatatttttattatggtaaaaaattttctaaatatgttctacatgtttcttatttatttgcctctgaaggaaggttggcctgaagaactgaaagaacctcttattttgcaagacaggcccaagcatgtaatacttttgtaccatatgagatttatatgaaataaattttttaaaaataaggaa

SEQ ID NO: 355602 - DNA, 671 bp, Homo sapiens
tgtgggcgtccgtcgtggtcttctgatgacgcagttagtcggctgcaatggcgccggtgaggcggtccgcgaagtggcggcctggtggtattgaggcgcgtggtgaaggggtttccactgtcgggtacaggaataagaatgtgagacagaagacatggcggcctaaccacccgcaagccttcgtggggagcgttcgcgagggacaaggctttgcttttcgaagaaaactgaaaatacagcaaagttacaagaaattgctacggaaggaaaagaaggctcaaacgtcactggaatctcaattcacagatcgatacccagataatctgaaacatctctatttagctgaagaggaaagacataggaagcaagcaagaaaagtcgaccatcctttgtcagaacaagttcaccagccgttgcttgaagaacagtgtagcattgacgagcctttatttgaagatcagtgtagctttgaccagcctcagccagaagaacaatgtattaaaacagtaaactcctttacaattccaaagaaaaataaaaagaaaacatcaaatcaaaaagcacaagaagaatatgaacagatacaagccaaacgtgctgctaagaaacaaattagagtgttcaaagcaggcccgagccgcctggataccgcacaaagaaataaaagtaag

SEQ ID NO: 355603 - DNA, 1218 bp, Homo sapiens
aataggactgaggacaggtctctggatttgtggactaggcagtcactagtcactagtccaaagtcgctagtgattagtagctattaaaatattatattgtagttacagagtatagtgaaaagttgaatgatagaggaaagtaaagttattactgaatcaaggatgctgaggaaatgaatggaattccaagtagttggattagccttgacaaaaaggacatcttcagagaggtgagaagtagttaaagatagaacagttcaaaatggtatctagatccaaggtatggtgattcatgactaggtaggtaaaatggaatagagaggaggggctcagaaaacttcgagattaaagttcatatatacacataattttcttaacatccttaaacaacaagtttaattcttttttcagtctggcatttctatcattcatatactggtttcattacttttaaaagtttttttttttaacattttaggatttttcatagctttctatattttttcctagttgaaatatttctctaagaatccccatttgtgccttttatttaatatatactcttaaaagctacaactgtgtttttaatacctttttggacattttactaataaagtcctgtttcctcatcccccaattaaaagctcctttacaattccaaagaaaaataaaaagaaaacatcaaatcaaaaagcacaagaagaatatgaacagatacaagccaaacgtgctgctaagaaacaagaattcgagaggagaaaacaggagagagaagaagcccaaaggcagtacaaaaagaagaaaatggaagtgtttaaaatactgaacaaaaagactaaaaagggccaaccaaacttgaatgtacaaatggagtaccttcttcaaaaaatacaagaaaaatgttaaacattttgttcctacaggttaaaatatctgctgcctattaggttcttctgtgacatgtgcctcccagcagtgaactaaatttgtcgacataaactggattgctaaactatgctaaatataagatgttcacatatttttattatggtaaaaaattttctaaatatgttctacatgtttcttatttatttgcctctgaaggaaggttggcctgaagaactgaaagaacctcttattttgcaagacaggcccaagcatgtaatacttttgtaccatatgagatttatatgaaataaattttttaaaaataaggaa

SEQ ID NO: 355604 - DNA, 970 bp, Homo sapiens
ctaaagatatgtaattttgcttgtttttgctttagaatatctgtaattaagaattcttaacatcaaaaatgttttcattgttcttaagctggtggcagattaggagaaagcaggaaaatttcttcatgggaatactggaccagtattaactagcacagctttatgctttttccaaccatctgtcacctttggaaacagtatatcagatgaagtgcagtaatgaccattatgctgtaaaacatttaatgtccttttaaaattttgtttatatagagctggggctttgtgatcatgaaaattctctgttataccatgggtcattataatatgaaggcaaagagggtactttgcttcaattaggagaaacagtgcacatcttgcaaaatagaagagacaaaccttagagtgtttgcttagtaatagctatttcaagacaatttctgaactgtatctactgtttgttgctaatgaaagttacatatgttaataattttaggaattcgagaggagaaaacaggagagagaagaagcccaaaggcagtacaaaaagaagaaaatggaagtgtttaaaatactgaacaaaaagactaaaaagggccaaccaaacttgaatgtacaaatggagtaccttcttcaaaaaatacaagaaaaatgttaaacattttgttcctacaggttaaaatatctgctgcctattaggttcttctgtgacatgtgcctcccagcagtgaactaaatttgtcgacataaactggattgctaaactatgctaaatataagatgttcacatatttttattatggtaaaaaattttctaaatatgttctacatgtttcttatttatttgcctctgaaggaaggttggcctgaagaactgaaagaacctcttattttgcaagacaggcccaagcatgtaatacttttgtaccatatgagatttatatgaaataaattttttaaaaataaggaa

SEQ ID NO: 355605 - DNA, 1580 bp, Homo sapiens
tgtgggcgtccgtcgtggtcttctgatgacgcagttagtcggctgcaatggcgccggtgaggcggtccgcgaagtggcggcctggtggtattgaggcgcgtggtgaaggggtttccactgtcgggtacaggaataagaatgtgagacagaagacatggcggcctaaccacccgcaagccttcgtggggagcgttcgcgagggacaaggctttgcttttcgaagaaaactgaaaatacagcaaagttacaagaaattgctacggaaggaaaagaaggctcaaacgtcactggaatctcaattcacagatcgatacccagataatctgaaacatctctatttagctgaagaggaaagacataggaagcaagcaagaaaagtcgaccatcctttgtcagaacaagttcaccagccgttgcttgaagaacagtgtagcattgacgagcctttatttgaagatcagtgtagctttgaccagcctcagccagaagaacaatgtattaaaacagtaaactcctttacaattccaaagaaaaataaaaagaaaacatcaaatcaaaaagcacaagaagaatatgaacagatacaagccaaacgtgctgctaagaaacaagaattcgagaggagaaaacaggagagagaagaagcccaaaggcagtacaaaaagaagaaaatggaagtgtttaaaatactgaacaaaaagactaaaaagggccaaccaaacttgaatgtacaaatggagtaccttcttcaaaaaatacaagaaaaatgttaaacattttgttcctacaggttaaaatatctgctgcctattaggttcttctgtgacatgtgcctcccagcagtgaactaaatttgtcgacataaactggattgctaaactatgctaaatataagatgttcacatatttttattatggtaaaaaattttctaaatatgttctacatgtttcttatttatttgcctctgaaggaaggttggcctgaagaactgaaagaacctcttattttgcaagacaggcccaagcatgtaatacttttgtaccatatgagatttatatgaaataaattttttaaaaataaggaaaaaaaaaaaaaaaaaaaaaaaaaaaaaaagaaaaaaaaaacaaaaagtaagaaacaaataaaataaaagataaagaagggcgcataaatagtcagcaaagaatcagcacccaaagcagtgaaaccacctatcagtgccaccaagagtcgagtagacactaatgaagcgtacaaacttcttaacacacctctcatgtaacagcatgagcagaccggacacctagcctaattacatcaccgtgagctcttcgctattgacaatacggacctcatccgccgaacaactacatcagcgaaaaggagacataaccctgatgtggcatggaggaaaaatactatagactggcacaccatctctcctcgatgagcattatacgacagcccatagctatataccccttacatctttcacaggattctgatgtagcggacccacacaatcgtcatagctttctgatcatggaatgatggctaatcgcgcgttattctcagcata

SEQ ID NO: 355606 - DNA, 1620 bp, Homo sapiens
tgtgggcgtccgtcgtggtcttctgatgacgcagttagtcggctgcaatggcgccggtgaggcggtccgcgaagtggcggcctggtggtattgaggcgcgtggtgaaggggtttccactgtcgggtacaggaataagaatgtgagacagaagacatggcggcctaaccacccgcaagccttcgtggggagcgttcgcgagggacaaggctttgcttttcgaagaaaactgaaaatacagcaaagttacaagaaattgctacggaaggaaaagaaggctcaaacgtcactggaatctcaattcacagatcgatacccagataatctgaaacatctctatttagctgaagaggaaagacataggaagcaagcaagaaaagtcgaccatcctttgtcagaacaagttcaccagccgttgcttgaagaacagtgtagcattgacgagcctttatttgaagatcagtgtagctttgaccagcctcagccagaagaacaatgtattaaaacagtaaactcctttacaattccaaagaaaaataaaaagaaaacatcaaatcaaaaagcacaagaagaatatgaacagatacaagccaaacgtgctgctaagaaacaagaattcgagaggagaaaacaggagagagaagaagcccaaaggcagtacaaaaagaagaaaatggaagtgtttaaaatactgaacaaaaagactaaaaagggccaaccaaacttgaatgtacaaatggagtaccttcttcaaaaaatacaagaaaaatgttaaacattttgttcctacaggttaaaatatctgctgcctattaggttcttctgtgacatgtgcctcccagcagtgaactaaatttgtcgacataaactggattgctaaactatgctaaatataagatgttcacatatttttattatggtaaaaaattttctaaatatgttctacatgtttcttatttatttgcctctgaaggaaggttggcctgaagaactgaaagaacctcttattttgcaagacaggcccaagcatgtaatacttttgtaccatatgagatttatatgaaataaattttttaaaaataaggaatcagagctatcaatgaagcatttcaatgaaatatttcaatttagtaaacagttacgttgttttaaaatttattttaatgatgagggaggcaaagactcctcttggactttttatttattttaagtacatgttacagggtgatgggtgctgaaataaactgccctcaccatataacaaagcgaccttcacaaagcagtgaactcaaagtctgatatttataaacattcccttaaatgggtgtacatggcttgttagtctaaggtcttttaaataatgatggaaaccccacagtgtcacagcaagaattaagctttccagttcctatggaccctatactttaagaacattatctctgtctcccttgttggtacccttgtgagctgagataagccactgggataactgcttctcatgctttgcaaattgcagaagaatgagaaaggcttgaaatatatatatagtcattgtaagcaaaaagggctgaccaataatacttgccaaatattgaataataaaattttataaatgatagcaa

SEQ ID NO: 355607 - DNA, 630 bp, Homo sapiens
  misc_feature (1)..(1): n is a, c, g, or t
nattcaggtaatagcctctcttctgggtcagagctttccaccaggctttgattcctgtgattgggatttggaaacagaagtgatagggggaggccgggcgcggtgctaacgcctgtaatcccagcattttgggaggctgaagcagacagctggtcttgaactcctgacctcgtgatccacccgccttggcctcccaaagtgctgggattacaggcatgagccaccgcacctggccttccctgcttcctctctagaatccaattagggatgtttgttactactcatattgattaaaacagttaacaaacttttttctttttaaaatgtgagatcagtgaactctggttttaagataatctgaaacaaggtccttgggagtaataaaattggtcacattctgtaaagcacattctgtttaggaatcaacttatctcaaattgtaactcggggcctaactatatgagatggctgaaaaaataccacatcgtctgttttcactaggtgatgccaaaatattttgctttatgtatattacagttctttttaaaacactggaagactcatgttaaactctaattgtgaaggcagaatctctgctaatttttcagattaaaattctctttgaaaaaa

SEQ ID NO: 355608 - DNA, 2967 bp, Homo sapiens
cgagctcgccctgagatccctccgctcagcgccttcaacgccgtgtcccggcaccccgcacccgggcacacaaaaaacgggtcgcccgcgattctcagggattgatcgcctcttcagaaaagtcctccatacattttctccccaattccattccttgggcatgccatagcatttgggaaaagtccaattgaatttctagaaaatgcatatgagaagtatggacctgtatttagttttaccatggtaggcaagacatttacttaccttctggggagtgatgctgctgcactgctttttaatagtaaaaatgaagacctgaatgcagaagatgtctacagtcgcctgacaacacctgtgtttgggaagggagttgcatacgatgtgcctaatccagttttcttggagcagaagaaaatgttaaaaagtggccttaacatagcccactttaaacagcatgtttctataattgaaaaagaaacaaaggaatactttgagagttggggagaaagtggagaaaaaaatgtgtttgaagctctttctgagctcataattttaacagctagccattgtttgcatggaaaggaaatcagaagtcaactcaatgaaaaggtagcacagctgtatgcagatttggatggaggtttcagccatgcagcctggctcttaccaggttggctgcctttgcctagtttcagacgcagggacagagctcatcgggaaatcaaggatattttctataaggcaatccagaaacgcagacagtctcaagaaaaaattgatgacattctccaaactttactagatgctacatacaaggatgggcgtcctttgactgatgatgaagtagcagggatgcttattggattactcttggcagggcagcatacatcctcaactactagtgcttggatgggcttctttttggccagagacaaaacacttcaaaaaaaatgttatttagaacagaaaacagtctgtggagagaatctgcctcctttaacttatgaccagctcaaggatctaaatttacttgatcgctgtataaaagaaacattaagacttagacctcctataatgatcatgatgagaatggccagaactcctcagactgtggcagggtataccattcctccaggacatcaggtgtgtgtttctcccactgtcaatcaaagacttaaagactcatgggtagaacgcctggactttaatcctgatcgctacttacaggataacccagcatcaggggaaaagtttgcctatgtgccatttggagctgggcgtcatcgttgtattggggaaaattttgcctatgttcaaattaagacaatttggtccactatgcttcgtttatatgaatttgatctcattgatggatactttcccactgtgaattatacaactatgattcacacccctgaaaacccagttatccgttacaaacgaagatcaaaatgaaaaaggttgcaaggaacgaatatatgtgattatcactgtaagccacaaaggcattcgaagagaatgaagtgtacaaaacaactcttgtagtttactgtttttttaagtgtgtaattctaaaagccagtttatgatttaggattttgttaactgaatggttctatcaaatataatagcatttgaaacattttctaatagttatgatacttatacatgtgctttcaggaagttccttggtgaaacaattgttgaggggggatctaggtaattggcagattctaaataatataatttccagatagtaattttaagagtactcatcgctcttgccaaataagttcagggtattcaaatcttggactagtcctgcaaggtataaagaataaaaatcccagtgagatacttggaaaccacagtttattattatttatctgggcaattattgtgtgtgtgaggatggaagggtagggaataatcgaacatctaaagccttgaataagagaatactaattgttttggtatgatgatactcagaaatggagatattataggaaaaagaaatcctttggaattttaactaaaatcactgcatatgggaaattaagagatccaggaccatatttgataagagttcctaaaaataatgtaattattaatgctaaagactgctcatgtatcttgatctaattactaaataattacatatttatttacctgataaatatgtatctagttctacaaggtcacatttatgtggaagtccaaagtcaagtccttaggggataattttgttttggctcagttgttccctgcttcctttttttttttttttttttgagatggagtctcgctctgttgcccaggctggagtgcagtggtgcgatctcagctcactgcatcctctgcctcccgggttcaagcaattctctgcctcagcctcccaagtagttgggattacaggcacctgccaccatgcctggctaattttttgtatttttagtagagacgggggtttcactatgttggctaggctggtcttgaactcctgacctcgtgatccacccgccttggcctcccaaagtgctgggattacaggcatgagccaccgcacctggccttccctgcttcctctctagaatccaattagggatgtttgttactactcatattgattaaaacagttaacaaacttttttctttttaaaatgtgagatcagtgaactctggttttaagataatctgaaacaaggtccttgggagtaataaaattggtcacattctgtaaagcacattctgtttaggaatcaacttatctcaaattgtaactcggggcctaactatatgagatggctgaaaaaataccacatcgtctgttttcactaggtgatgccaaaatattttgctttatgtatattacagttctttttaaaacactggaagactcatgttaaactctaattgtgaaggcagaatctctgctaatttttcagattaaaattctctttgaaaaaa

SEQ ID NO: 355609 - DNA, 2670 bp, Homo sapiens
caggagtggcctggggttcacagtggctgttgcacatatctcctgcacactcacagccatgttgatgtgtcctgatgggagaagactgggcatcttgttttcttggagcagaagaaaatgttaaaaagtggccttaacatagcccactttaaacagcatgtttctataattgaaaaagaaacaaaggaatactttgagagttggggagaaagtggagaaaaaaatgtgtttgaagctctttctgagctcataattttaacagctagccattgtttgcatggaaaggaaatcagaagtcaactcaatgaaaaggtagcacagctgtatgcagatttggatggaggtttcagccatgcagcctggctcttaccaggttggctgcctttgcctagtttcagacgcagggacagagctcatcgggaaatcaaggatattttctataaggcaatccagaaacgcagacagtctcaagaaaaaattgatgacattctccaaactttactagatgctacatacaaggatgggcgtcctttgactgatgatgaagtagcagggatgcttattggattactcttggcagggcagcatacatcctcaactactagtgcttggatgggcttctttttggccagagacaaaacacttcaaaaaaaatgttatttagaacagaaaacagtctgtggagagaatctgcctcctttaacttatgaccagctcaaggatctaaatttacttgatcgctgtataaaagaaacattaagacttagacctcctataatgatcatgatgagaatggccagaactcctcagactgtggcagggtataccattcctccaggacatcaggtgtgtgtttctcccactgtcaatcaaagacttaaagactcatgggtagaacgcctggactttaatcctgatcgctacttacaggataacccagcatcaggggaaaagtttgcctatgtgccatttggagctgggcgtcatcgttgtattggggaaaattttgcctatgttcaaattaagacaatttggtccactatgcttcgtttatatgaatttgatctcattgatggatactttcccactgtgaattatacaactatgattcacacccctgaaaacccagttatccgttacaaacgaagatcaaaatgaaaaaggttgcaaggaacgaatatatgtgattatcactgtaagccacaaaggcattcgaagagaatgaagtgtacaaaacaactcttgtagtttactgtttttttaagtgtgtaattctaaaagccagtttatgatttaggattttgttaactgaatggttctatcaaatataatagcatttgaaacattttctaatagttatgatacttatacatgtgctttcaggaagttccttggtgaaacaattgttgaggggggatctaggtaattggcagattctaaataatataatttccagatagtaattttaagagtactcatcgctcttgccaaataagttcagggtattcaaatcttggactagtcctgcaaggtataaagaataaaaatcccagtgagatacttggaaaccacagtttattattatttatctgggcaattattgtgtgtgtgaggatggaagggtagggaataatcgaacatctaaagccttgaataagagaatactaattgttttggtatgatgatactcagaaatggagatattataggaaaaagaaatcctttggaattttaactaaaatcactgcatatgggaaattaagagatccaggaccatatttgataagagttcctaaaaataatgtaattattaatgctaaagactgctcatgtatcttgatctaattactaaataattacatatttatttacctgataaatatgtatctagttctacaaggtcacatttatgtggaagtccaaagtcaagtccttaggggataattttgttttggctcagttgttccctgcttcctttttttttttttttttttgagatggagtctcgctctgttgcccaggctggagtgcagtggtgcgatctcagctcactgcatcctctgcctcccgggttcaagcaattctctgcctcagcctcccaagtagttgggattacaggcacctgccaccatgcctggctaattttttgtatttttagtagagacgggggtttcactatgttggctaggctggtcttgaactcctgacctcgtgatccacccgccttggcctcccaaagtgctgggattacaggcatgagccaccgcacctggccttccctgcttcctctctagaatccaattagggatgtttgttactactcatattgattaaaacagttaacaaacttttttctttttaaaatgtgagatcagtgaactctggttttaagataatctgaaacaaggtccttgggagtaataaaattggtcacattctgtaaagcacattctgtttaggaatcaacttatctcaaattgtaactcggggcctaactatatgagatggctgaaaaaataccacatcgtctgttttcactaggtgatgccaaaatattttgctttatgtatattacagttctttttaaaacactggaagactcatgttaaactctaattgtgaaggcagaatctctgctaatttttcagattaaaattctctttgaaaaaa

SEQ ID NO: 355610 - DNA, 1895 bp, Homo sapiens
gactctagagtatcccccggcagaatcacactcaaactgtggcagggtataccattcctccaggacatcaggtgtgtgtttctcccactgtcaatcaaagacttaaagactcatgggtagaacgcctggactttaatcctgatcgctacttacaggataacccagcatcaggggaaaagtttgcctatgtgccatttggagctgggcgtcatcgttgtattggggaaaattttgcctatgttcaaattaagacaatttggtccactatgcttcgtttatatgaatttgatctcattgatggatactttcccactgtgaattatacaactatgattcacacccctgaaaacccagttatccgttacaaacgaagatcaaaatgaaaaaggttgcaaggaacgaatatatgtgattatcactgtaagccacaaaggcattcgaagagaatgaagtgtacaaaacaactcttgtagtttactgtttttttaagtgtgtaattctaaaagccagtttatgatttaggattttgttaactgaatggttctatcaaatataatagcatttgaaacattttctaatagttatgatacttatacatgtgctttcaggaagttccttggtgaaacaattgttgaggggggatctaggtaattggcagattctaaataatataatttccagatagtaattttaagagtactcatcgctcttgccaaataagttcagggtattcaaatcttggactagtcctgcaaggtataaagaataaaaatcccagtgagatacttggaaaccacagtttattattatttatctgggcaattattgtgtgtgtgaggatggaagggtagggaataatcgaacatctaaagccttgaataagagaatactaattgttttggtatgatgatactcagaaatggagatattataggaaaaagaaatcctttggaattttaactaaaatcactgcatatgggaaattaagagatccaggaccatatttgataagagttcctaaaaataatgtaattattaatgctaaagactgctcatgtatcttgatctaattactaaataattacatatttatttacctgataaatatgtatctagttctacaaggtcacatttatgtggaagtccaaagtcaagtccttaggggataattttgttttggctcagttgttccctgcttcctttttttttttttttttttgagatggagtctcgctctgttgcccaggctggagtgcagtggtgcgatctcagctcactgcatcctctgcctcccgggttcaagcaattctctgcctcagcctcccaagtagttgggattacaggcacctgccaccatgcctggctaattttttgtatttttagtagagacgggggtttcactatgttggctaggctggtcttgaactcctgacctcgtgatccacccgccttggcctcccaaagtgctgggattacaggcatgagccaccgcacctggccttccctgcttcctctctagaatccaattagggatgtttgttactactcatattgattaaaacagttaacaaacttttttctttttaaaatgtgagatcagtgaactctggttttaagataatctgaaacaaggtccttgggagtaataaaattggtcacattctgtaaagcacattctgtttaggaatcaacttatctcaaattgtaactcggggcctaactatatgagatggctgaaaaaataccacatcgtctgttttcactaggtgatgccaaaatattttgctttatgtatattacagttctttttaaaacactggaagactcatgttaaactctaattgtgaaggcagaatctctgctaatttttcagattaaaattctctttgaaaaaa

SEQ ID NO: 355611 - DNA, 2280 bp, Homo sapiens
cgagctcgccctgagatccctccgctcagcgccttcaacgccgtgtcccggcaccccgcacccgggcacacaaaaaacgggtcgcccgcgattctcagggattgatcgcctcttcaggtaagttatcttccggccccgtaccactgtgccacaggcgcagcccgcttcctcaggtgccctatcccgcgcagaagaccacggcttcacagagtgttatttaagggcgtggccagcggaacatcccgccccattctgtgacgcacggggtggcgcgcgtgggacccgaggggtggggctgggtttagtaggagacctggggcaaggccccctgtggacgaccatctgccagcttctctcgttccgtcgattgggaggagcggtggcgacctcggccttcagtgtttccgacggagtgaatggcggcggcggctgggatgctgctgctgggcttgctgcaggcgggtgggtcggtgctgggccaggcgatggagaaggtgacaggcggcaacctcttgtccatgctgctgatcgcctgcgccttcaccctcagcctggtctacctgatccgtctggccgccggccacctggtccagctgcccgcaggggtgaaaagtcctccatacattttctccccaattccattccttgggcatgccatagcatttgggaaaagtccaattgaatttctagaaaatgcatatgagaagtatggacctgtatttagttttaccatggtaggcaagacatttacttaccttctggggagtgatgctgctgcactgctttttaatagtaaaaatgaagacctgaatgcagaagatgtctacagtcgcctgacaacacctgtgtttgggaagggagttgcatacgatgtgcctaatccagttttcttggagcagaagaaaatgttaaaaagtggccttaacatagcccactttaaacagcatgtttctataattgaaaaagaaacaaaggaatactttgagagttggggagaaagtggagaaaaaaatgtgtttgaagctctttctgagctcataattttaacagctagccattgtttgcatggaaaggaaatcagaagtcaactcaatgaaaaggtagcacagctgtatgcagatttggatggaggtttcagccatgcagcctggctcttaccaggttggctgcctttgcctagtttcagacgcagggacagagctcatcgggaaatcaaggatattttctataaggcaatccagaaacgcagacagtctcaagaaaaaattgatgacattctccaaactttactagatgctacatacaaggatgggcgtcctttgactgatgatgaagtagcagggatgcttattggattactcttggcagggcagcatacatcctcaactactagtgcttggatgggcttctttttggccagagacaaaacacttcaaaaaaaatgttatttagaacagaaaacagtctgtggagagaatctgcctcctttaacttatgaccagctcaaggatctaaatttacttgatcgctgtataaaagaaacattaagacttagacctcctataatgatcatgatgagaatggccagaactcctcagactgtggcagggtataccattcctccaggacatcaggtgtgtgtttctcccactgtcaatcaaagacttaaagactcatgggtagaacgcctggactttaatcctgatcgctacttacaggataacccagcatcaggggaaaagtttgcctatgtgccatttggagctgggcgtcatcgttgtattggggaaaattttgcctatgttcaaattaagacaatttggtccactatgcttcgtttatatgaatttgatctcattgatggatactttcccactgtgaattatacaactatgattcacacccctgaaaacccagttatccgttacaaacgaagatcaaaatgaaaaaggttgcaaggaacgaatatatgtgattatcactgtaagccacaaaggcattcgaagagaatgaagtgtacaaaacaactcttgtagtttactgtttttttaagtgtgtaattctaaaagccagtttatgatttaggattttgttaactgaatggtttatatgagatggctgaaaaaataccacatcgtctgttttcactaggtgatgccaaaatattttgctttatgtatattacagttctttttaaaacactggaagactcatgttaaactctaattgtgaaggcagaatctctgctaatttttcagattaaaattctctttgaaaaaa

SEQ ID NO: 355612 - DNA, 530 bp, Homo sapiens
ggtaccccccccatacgttagggatgcccatttcaagattaatattcccaccttcaaataaaagtctgccttctgttccaaaaaattaaatcggttgccaaagaggaagttaccgagcaaccaccgcacctggccttccctgcttcctctctagaatccaattagggatgtttgttactactcatattgattaaaacagttaacaaacttttttctttttaaaatgtgagatcagtgaactctggttttaagataatctgaaacaaggtccttgggagtaataaaattggtcacattctgtaaagcacattctgtttaggaatcaacttatctcaaattgtaactcggggcctaactatatgagatggctgaaaaaataccacatcgtctgttttcactaggtgatgccaaaatattttgctttatgtatattacagttctttttaaaacactggaagactcatgttaaactctaattgtgaaggcagaatctctgctaatttttcagattaaaattctctttgaaaaaa

SEQ ID NO: 355613 - DNA, 224 bp, Homo sapiens
acttatctcaaattgtaactcggggcctaactatatgagatggctgaaaaaataccacatcgtctgttttcactaggtgatgccaaaatattttgctttatgtatattacagttctttttaaaacactggaagactcatgttaaactctaattgtgaaggcagaatctctgctaatttttcagattaaaattctctttgaaaaaatacagtctgtattcatgaa

SEQ ID NO: 355614 - DNA, 3458 bp, Homo sapiens
cgagctcgccctgagatccctccgctcagcgccttcaacgccgtgtcccggcaccccgcacccgggcacacaaaaaacgggtcgcccgcgattctcagggattgatcgcctcttcaggtaagttatcttccggccccgtaccactgtgccacaggcgcagcccgcttcctcaggtgccctatcccgcgcagaagaccacggcttcacagagtgttatttaagggcgtggccagcggaacatcccgccccattctgtgacgcacggggtggcgcgcgtgggacccgaggggtggggctgggtttagtaggagacctggggcaaggccccctgtggacgaccatctgccagcttctctcgttccgtcgattgggaggagcggtggcgacctcggccttcagtgtttccgacggagtgaatggcggcggcggctgggatgctgctgctgggcttgctgcaggcgggtgggtcggtgctgggccaggcgatggagaaggtgacaggcggcaacctcttgtccatgctgctgatcgcctgcgccttcaccctcagcctggtctacctgatccgtctggccgccggccacctggtccagctgcccgcaggggtgaaaagtcctccatacattttctccccaattccattccttgggcatgccatagcatttgggaaaagtccaattgaatttctagaaaatgcatatgagaagtatggacctgtatttagttttaccatggtaggcaagacatttacttaccttctggggagtgatgctgctgcactgctttttaatagtaaaaatgaagacctgaatgcagaagatgtctacagtcgcctgacaacacctgtgtttgggaagggagttgcatacgatgtgcctaatccagttttcttggagcagaagaaaatgttaaaaagtggccttaacatagcccactttaaacagcatgtttctataattgaaaaagaaacaaaggaatactttgagagttggggagaaagtggagaaaaaaatgtgtttgaagctctttctgagctcataattttaacagctagccattgtttgcatggaaaggaaatcagaagtcaactcaatgaaaaggtagcacagctgtatgcagatttggatggaggtttcagccatgcagcctggctcttaccaggttggctgcctttgcctagtttcagacgcagggacagagctcatcgggaaatcaaggatattttctataaggcaatccagaaacgcagacagtctcaagaaaaaattgatgacattctccaaactttactagatgctacatacaaggatgggcgtcctttgactgatgatgaagtagcagggatgcttattggattactcttggcagggcagcatacatcctcaactactagtgcttggatgggcttctttttggccagagacaaaacacttcaaaaaaaatgttatttagaacagaaaacagtctgtggagagaatctgcctcctttaacttatgaccagctcaaggatctaaatttacttgatcgctgtataaaagaaacattaagacttagacctcctataatgatcatgatgagaatggccagaactcctcagactgtggcagggtataccattcctccaggacatcaggtgtgtgtttctcccactgtcaatcaaagacttaaagactcatgggtagaacgcctggactttaatcctgatcgctacttacaggataacccagcatcaggggaaaagtttgcctatgtgccatttggagctgggcgtcatcgttgtattggggaaaattttgcctatgttcaaattaagacaatttggtccactatgcttcgtttatatgaatttgatctcattgatggatactttcccactgtgaattatacaactatgattcacacccctgaaaacccagttatccgttacaaacgaagatcaaaatgaaaaaggttgcaaggaacgaatatatgtgattatcactgtaagccacaaaggcattcgaagagaatgaagtgtacaaaacaactcttgtagtttactgtttttttaagtgtgtaattctaaaagccagtttatgatttaggattttgttaactgaatggttctatcaaatataatagcatttgaaacattttctaatagttatgatacttatacatgtgctttcaggaagttccttggtgaaacaattgttgaggggggatctaggtaattggcagattctaaataatataatttccagatagtaattttaagagtactcatcgctcttgccaaataagttcagggtattcaaatcttggactagtcctgcaaggtataaagaataaaaatcccagtgagatacttggaaaccacagtttattattatttatctgggcaattattgtgtgtgtgaggatggaagggtagggaataatcgaacatctaaagccttgaataagagaatactaattgttttggtatgatgatactcagaaatggagatattataggaaaaagaaatcctttggaattttaactaaaatcactgcatatgggaaattaagagatccaggaccatatttgataagagttcctaaaaataatgtaattattaatgctaaagactgctcatgtatcttgatctaattactaaataattacatatttatttacctgataaatatgtatctagttctacaaggtcacatttatgtggaagtccaaagtcaagtccttaggggataattttgttttggctcagttgttccctgcttcctttttttttttttttttttgagatggagtctcgctctgttgcccaggctggagtgcagtggtgcgatctcagctcactgcatcctctgcctcccgggttcaagcaattctctgcctcagcctcccaagtagttgggattacaggcacctgccaccatgcctggctaattttttgtatttttagtagagacgggggtttcactatgttggctaggctggtcttgaactcctgacctcgtgatccacccgccttggcctcccaaagtgctgggattacaggcatgagccaccgcacctggccttccctgcttcctctctagaatccaattagggatgtttgttactactcatattgattaaaacagttaacaaacttttttctttttaaaatgtgagatcagtgaactctggttttaagataatctgaaacaaggtccttgggagtaataaaattggtcacattctgtaaagcacattctgtttaggaatcaacttatctcaaattgtaactcggggcctaactatatgagatggctgaaaaaataccacatcgtctgttttcactaggtgatgccaaaatattttgctttatgtatattacagttctttttaaaacactggaagactcatgttaaactctaattgtgaaggcagaatctctgctaatttttcagattaaaattctctttgaaaaaa

SEQ ID NO: 355615 - DNA, 3402 bp, Homo sapiens
  misc_feature (1119)..(1119): n is a, c, g, or t
cgagctcgccctgagatccctccgctcagcgccttcaacgccgtgtcccggcaccccgcacccgggcacacaaaaaacgggtcgcccgcgattctcagggattgatcgcctcttcaggtaagttatcttccggccccgtaccactgtgccacaggcgcagcccgcttcctcaggtgccctatcccgcgcagaagaccacggcttcacagagtgttatttaagggcgtggccagcggaacatcccgccccattctgtgacgcacggggtggcgcgcgtgggacccgaggggtggggctgggtttagtaggagacctggggcaaggccccctgtggacgaccatctgccagcttctctcgttccgtcgattgggaggagcggtggcgacctcggccttcagtgtttccgacggagtgaatggcggcggcggctgggatgctgctgctgggcttgctgcaggcgggtgggtcggtgctgggccaggcgatggagaaggtgacaggcggcaacctcttgtccatgctgctgatcgcctgcgccttcaccctcagcctggtctacctgatccgtctggccgccggccacctggtccagctgcccgcaggggtgaaaagtcctccatacattttctccccaattccattccttgggcatgccatagcatttgggaaaagtccaattgaatttctagaaaatgcatatgagaagtatggacctgtatttagttttaccatggtaggcaagacatttacttaccttctggggagtgatgctgctgcactgctttttaatagtaaaaatgaagacctgaatgcagaagatgtctacagtcgcctgacaacacctgtgtttgggaagggagttgcatacgatgtgcctaatccagttttcttggagcagaagaaaatgttaaaaagtggccttaacatagcccactttaaacagcatgtttctataattgaaaaagaaacaaaggaatactttgagagttggggagaaagtggagaaaaaaatgtgtttgaagctctttctgagctcataattttaacagctagccattgtttgcatggaaaggaaatcagaagtcaactcaatgtggctcttaccagtttgcttgccntgcctaggttcacgcagggacagagctcatcgggaaatcaaggatattttctataaggcaatccagaaacgcagacagtctcaagaaaaaattgatgacattctccaaactttactagatgctacatacaaggatgggcgtcctttgactgatgatgaagtagcagggatgcttattggattactcttggcagggcagcatacatcctcaactactagtgcttggatgggcttctttttggccagagacaaaacacttcaaaaaaaatgttatttagaacagaaaacagtctgtggagagaatctgcctcctttaacttatgaccagctcaaggatctaaatttacttgatcgctgtataaaagaaacattaagacttagacctcctataatgatcatgatgagaatggccagaactcctcagactgtggcagggtataccattcctccaggacatcaggtgtgtgtttctcccactgtcaatcaaagacttaaagactcatgggtagaacgcctggactttaatcctgatcgctacttacaggataacccagcatcaggggaaaagtttgcctatgtgccatttggagctgggcgtcatcgttgtattggggaaaattttgcctatgttcaaattaagacaatttggtccactatgcttcgtttatatgaatttgatctcattgatggatactttcccactgtgaattatacaactatgattcacacccctgaaaacccagttatccgttacaaacgaagatcaaaatgaaaaaggttgcaaggaacgaatatatgtgattatcactgtaagccacaaaggcattcgaagagaatgaagtgtacaaaacaactcttgtagtttactgtttttttaagtgtgtaattctaaaagccagtttatgatttaggattttgttaactgaatggttctatcaaatataatagcatttgaaacattttctaatagttatgatacttatacatgtgctttcaggaagttccttggtgaaacaattgttgaggggggatctaggtaattggcagattctaaataatataatttccagatagtaattttaagagtactcatcgctcttgccaaataagttcagggtattcaaatcttggactagtcctgcaaggtataaagaataaaaatcccagtgagatacttggaaaccacagtttattattatttatctgggcaattattgtgtgtgtgaggatggaagggtagggaataatcgaacatctaaagccttgaataagagaatactaattgttttggtatgatgatactcagaaatggagatattataggaaaaagaaatcctttggaattttaactaaaatcactgcatatgggaaattaagagatccaggaccatatttgataagagttcctaaaaataatgtaattattaatgctaaagactgctcatgtatcttgatctaattactaaataattacatatttatttacctgataaatatgtatctagttctacaaggtcacatttatgtggaagtccaaagtcaagtccttaggggataattttgttttggctcagttgttccctgcttcctttttttttttttttttttgagatggagtctcgctctgttgcccaggctggagtgcagtggtgcgatctcagctcactgcatcctctgcctcccgggttcaagcaattctctgcctcagcctcccaagtagttgggattacaggcacctgccaccatgcctggctaattttttgtatttttagtagagacgggggtttcactatgttggctaggctggtcttgaactcctgacctcgtgatccacccgccttggcctcccaaagtgctgggattacaggcatgagccaccgcacctggccttccctgcttcctctctagaatccaattagggatgtttgttactactcatattgattaaaacagttaacaaacttttttctttttaaaatgtgagatcagtgaactctggttttaagataatctgaaacaaggtccttgggagtaataaaattggtcacattctgtaaagcacattctgtttaggaatcaacttatctcaaattgtaactcggggcctaactatatgagatggctgaaaaaataccacatcgtctgttttcactaggtgatgccaaaatattttgctttatgtatattacagttctttttaaaacactggaagactcatgttaaactctaattgtgaaggcagaatctctgctaatttttcagattaaaattctctttgaaaaaa

SEQ ID NO: 355616 - DNA, 3374 bp, Homo sapiens
cgagctcgccctgagatccctccgctcagcgccttcaacgccgtgtcccggcaccccgcacccgggcacacaaaaaacgggtcgcccgcgattctcagggattgatcgcctcttcaggtaagttatcttccggccccgtaccactgtgccacaggcgcagcccgcttcctcaggtgccctatcccgcgcagaagaccacggcttcacagagtgttatttaagggcgtggccagcggaacatcccgccccattctgtgacgcacggggtggcgcgcgtgggacccgaggggtggggctgggtttagtaggagacctggggcaaggccccctgtggacgaccatctgccagcttctctcgttccgtcgattgggaggagcggtggcgacctcggccttcagtgtttccgacggagtgaatggcggcggcggctgggatgctgctgctgggcttgctgcaggcgggtgggtcggtgctgggccaggcgatggagaaggtgacaggcggcaacctcttgtccatgctgctgatcgcctgcgccttcaccctcagcctggtctacctgatccgtctggccgccggccacctggtccagctgcccgcaggggtgaaaagtcctccatacattttctccccaattccattccttgggcatgccatagcatttgggaaaagtccaattgaatttctagaaaatgcatatgagaagtatggacctgtatttagttttaccatggtaggcaagacatttacttaccttctggggagtgatgctgctgcactgctttttaatagtaaaaatgaagacctgaatgcagaagatgtctacagtcgcctgacaacacctgtgtttgggaagggagttgcatacgatgtgcctaatccagttttcttggagcagaagaaaatgttaaaaagtggccttaacatagcccactttaaacagcatgtttctataattgaaaaagaaacaaaggaatactttgagagttggggagaaagtggagaaaaaaatgtgtttgaagctctttctgagctcataattttaacagctagccattgtttgcatggaaaggaaatcagaagtcaactcaatgaaaaggtagcacagctgtatgcagatttggatggaggtttcagccatgcagcctggctcttaccaggttggctgcctttgcctagtttcagacgcagggacagagctcatcgggaaatcaaggatattttctataaggcaatccagaaacgcagacagtctcaagaaaaaattgatgacattctccaaactttactagatgctacatacaaggatgggcgtcctttgactgatgatgaagtagcagggatgcttattggattactcttggcagggcagcatacatcctcaactactagtgcttggatgggcttctttttggccagagacaaaacacttcaaaaaaaatgttatttagaacagaaaacagtctgtggagagaatctgcctcctttaacttatgaccagctcaaggatctaaatttacttgatcgctgtataaaagaaacattaagacttagacctcctataatgatcatgatgagaatggccagaactcctcagactgtggcagggtataccattcctccaggacatcaggataacccagcatcaggggaaaagtttgcctatgtgccatttggagctgggcgtcatcgttgtattggggaaaattttgcctatgttcaaattaagacaatttggtccactatgcttcgtttatatgaatttgatctcattgatggatactttcccactgtgaattatacaactatgattcacacccctgaaaacccagttatccgttacaaacgaagatcaaaatgaaaaaggttgcaaggaacgaatatatgtgattatcactgtaagccacaaaggcattcgaagagaatgaagtgtacaaaacaactcttgtagtttactgtttttttaagtgtgtaattctaaaagccagtttatgatttaggattttgttaactgaatggttctatcaaatataatagcatttgaaacattttctaatagttatgatacttatacatgtgctttcaggaagttccttggtgaaacaattgttgaggggggatctaggtaattggcagattctaaataatataatttccagatagtaattttaagagtactcatcgctcttgccaaataagttcagggtattcaaatcttggactagtcctgcaaggtataaagaataaaaatcccagtgagatacttggaaaccacagtttattattatttatctgggcaattattgtgtgtgtgaggatggaagggtagggaataatcgaacatctaaagccttgaataagagaatactaattgttttggtatgatgatactcagaaatggagatattataggaaaaagaaatcctttggaattttaactaaaatcactgcatatgggaaattaagagatccaggaccatatttgataagagttcctaaaaataatgtaattattaatgctaaagactgctcatgtatcttgatctaattactaaataattacatatttatttacctgataaatatgtatctagttctacaaggtcacatttatgtggaagtccaaagtcaagtccttaggggataattttgttttggctcagttgttccctgcttcctttttttttttttttttttgagatggagtctcgctctgttgcccaggctggagtgcagtggtgcgatctcagctcactgcatcctctgcctcccgggttcaagcaattctctgcctcagcctcccaagtagttgggattacaggcacctgccaccatgcctggctaattttttgtatttttagtagagacgggggtttcactatgttggctaggctggtcttgaactcctgacctcgtgatccacccgccttggcctcccaaagtgctgggattacaggcatgagccaccgcacctggccttccctgcttcctctctagaatccaattagggatgtttgttactactcatattgattaaaacagttaacaaacttttttctttttaaaatgtgagatcagtgaactctggttttaagataatctgaaacaaggtccttgggagtaataaaattggtcacattctgtaaagcacattctgtttaggaatcaacttatctcaaattgtaactcggggcctaactatatgagatggctgaaaaaataccacatcgtctgttttcactaggtgatgccaaaatattttgctttatgtatattacagttctttttaaaacactggaagactcatgttaaactctaattgtgaaggcagaatctctgctaatttttcagattaaaattctctttgaaaaaa

SEQ ID NO: 355617 - DNA, 1901 bp, Homo sapiens
cgagctcgccctgagatccctccgctcagcgccttcaacgccgtgtcccggcaccccgcacccgggcacacaaaaaacgggtcgcccgcgattctcagggattgatcgcctcttcaggtaagttatcttccggccccgtaccactgtgccacaggcgcagcccgcttcctcaggtgccctatcccgcgcagaagaccacggcttcacagagtgttatttaagggcgtggccagcggaacatcccgccccattctgtgacgcacggggtggcgcgcgtgggacccgaggggtggggctgggtttagtaggagacctggggcaaggccccctgtggacgaccatctgccagcttctctcgttccgtcgattgggaggagcggtggcgacctcggccttcagtgtttccgacggagtgaatggcggcggcggctgggatgctgctgctgggcttgctgcaggcgggtgggtcggtgctgggccaggcgatggagaaggtgacaggcggcaacctcttgtccatgctgctgatcgcctgcgccttcaccctcagcctggtctacctgatccgtctggccgccggccacctggtccagctgcccgcaggggtgaaaagtcctccatacattttctccccaattccattccttgggcatgccatagcatttgggaaaagtccaattgaatttctagaaaatgcatatgagaagtatggacctgtatttagttttaccatggtaggcaagacatttacttaccttctggggagtgatgctgctgcactgctttttaatagtaaaaatgaagacctgaatgcagaagatgtctacagtcgcctgacaacacctgtgtttgggaagggagttgcatacgatgtgcctaatccagttttcttggagcagaagaaaatgttaaaaagtggccttaacatagcccactttaaacagcatgtttctataattgaaaaagaaacaaaggaatactttgagagttggggagaaagtggagaaaaaaatgtgtttgaagctctttctgagctcataattttaacagctagccattgtttgcatggaaaggaaatcagaagtcaactcaatgaaaaggtagcacagctgtatgcagatttggatggaggtttcagccatgcagcctggctcttaccaggttggctgcctttgcctagtttcagacgcagggacagagctcatcgggaaatcaaggatattttctataaggcaatccagaaacgcagacagtctcaagaaaaaattgatgacattctccaaactttactagatgctacatacaaggatgggcgtcctttgactgatgatgaatagttgggattacaggcacctgccaccatgcctggctaattttttgtatttttagtagagacgggggtttcactatgttggctaggctggtcttgaactcctgacctcgtgatccacccgccttggcctcccaaagtgctgggattacaggcatgagccaccgcacctggccttccctgcttcctctctagaatccaattagggatgtttgttactactcatattgattaaaacagttaacaaacttttttctttttaaaatgtgagatcagtgaactctggttttaagataatctgaaacaaggtccttgggagtaataaaattggtcacattctgtaaagcacattctgtttaggaatcaacttatctcaaattgtaactcggggcctaactatatgagatggctgaaaaaataccacatcgtctgttttcactaggtgatgccaaaatattttgctttatgtatattacagttctttttaaaacactggaagactcatgttaaactctaattgtgaaggcagaatctctgctaatttttcagattaaaattctctttgaaaaaa

SEQ ID NO: 355618 - DNA, 1571 bp, Homo sapiens
cgagctcgccctgagatccctccgctcagcgccttcaacgccgtgtcccggcaccccgcacccgggcacacaaaaaacgggtcgcccgcgattctcagggattgatcgcctcttcaggtaagttatcttccggccccgtaccactgtgccacaggcgcagcccgcttcctcaggtgccctatcccgcgcagaagaccacggcttcacagagtgttatttaagggcgtggccagcggaacatcccgccccattctgtgacgcacggggtggcgcgcgtgggacccgaggggtggggctgggtttagtaggagacctggggcaaggccccctgtggacgaccatctgccagcttctctcgttccgtcgattgggaggagcggtggcgacctcggccttcagtgtttccgacggagtgaatggcggcggcggctgggatgctgctgctgggcttgctgcaggcgggtgggtcggtgctgggccaggcgatggagaaggtgacaggcggcaacctcttgtccatgctgctgatcgcctgcgccttcaccctcagcctggtctacctgatccgtctggccgccggccacctggtccagctgcccgcaggggtgaaaagtcctccatacattttctccccaattccattccttgggcatgccatagcatttgggaaaagtccaattgaatttctagaaaatgcatatgagaagtatggacctgtatttagttttaccatggtaggcaagacatttacttaccttctggggagtgatgctgctgcactgctttttaatagtaaaaatgaagacctgaatgcagaagatgtctacagtcgcctgacaacacctgtgtttgggaagggagttgcatacgatgtgcctaatccagttttcttggagcagaagaaaatgttaaaaagtggccttaacatagcccactttaaacagcatgtttctataattgaaaaagaaacaaaggaatactttgagagttggggagaaagtggagaaaaaaatgtgtttgaagctctttctgagctcataattttaacagctagccattgtttgcatggaaaggaaatcagaagtcaactcaatgaaaaggtagcacagctgtatgcagatttggatggaggtttcagccatgcagcctggctcttaccaggttggctgcctttgcctagtttcagacgcagggacagagctcatcgggaaatcaaggatattttctataaggcaatccagaaacgcagacagtctcaagaaaaaattgatgacattctccaaactttactagatgctacatacaaggatgggcgtcctttgactgatgatgaagtagcagggatgcttattggattactcttggcagggcagcatacatcctcaactactagtgcttggatgggcttctttttggccagagacaaaacacttcaaaaaaaatgttatttagaacagaaaacagtctgtggagagaatctgcctcctttaacttatgaccagctcaaggatctaaatttacttgatcgctgtataactcctcagactgtggcagggtataccattcctcca

SEQ ID NO: 355619 - DNA, 206 bp, Homo sapiens
tttcctgcacatcctactctgtgttcaaaggtttccctgtgagagattagttcacagttgctgacacctcacaatctccctcacaacctgcaggaaccgttactttgagttgtcagagggtcattcagctcatagctacttttcaggatgatgctgggcaagagatctgccatcctaaaaatgatcctgatgtatgaggaaaaagc

SEQ ID NO: 355620 - DNA, 2170 bp, Homo sapiens
gcccctaaccgaggcagcagcggacgtgagcgataatggcggatatggaggatctcttcgggagcgacgccgacagcgaagctgagcgtaaagattctgattctggatctgactcagattctgatcaagagaatgctgcctctggcagtaatgcctctggaagtgaaagtgatcaggatgaaagaggtgattcaggacaaccaagtaataaggaactgtttggagatgacagtgaggacgagggagcttcacatcatagtggtagtgataatcactctgaaagatcagacaatagatcagaagcttctgagcgttctgaccatgaggacaatgacccctcagatgtagatcagcacagtggatcagaagcccctaatgatgatgaagacgaaggtcatagatcggatggagggagccatcattcagaagcagaaggttctgaaaaagcacattcagatgatgaaaaatggggcagagaagataaaagtgaccagtcagatgatgaaaagatacaaaattctgatgatgaggagagggcacaaggatctgatgaagataagctgcagaattctgacgatgatgagaaaatgcagaacacagatgatgaggagaggcctcagctttccgatgatgagagacaacagctatctgaggaggaaaaggctaattctgatgatgaacggccggtagcttctgataatgatgatgagaaacagaattctgatgatgaagaacaaccacagctgtctgatgaagagaaaatgcaaaattctgatgatgaaaggccacaggcctcagatgaagaacacaggcattcagatgatgaagaggaacaggatcataaatcagaatctgcaagaggcagtgatagtgaagatgaagttttacgaatgaaacgcaagaatgcgattgcatctgattcagaagcggatagtgacactgaggtgccaaaagataatagtggaaccatggatttatttggaggtgcagatgatatctcttcagggagtgatggagaagacaaaccacctactccaggacagcctgttgatgaaaatggattgcctcaggatcaacaggaagaggagccaattcctgagaccagaatagaagtagaaatacccaaagtaaacactgatttaggaaacgacttatattttgttaaactgcccaactttctcagtgtagagcccagaccttttgatcctcagtattatgaagatgaatttgaagatgaagaaatgctggatgaagaaggtagaaccaggttaaaattaaaggtagaaaatactataagatggaggatacgccgagatgaagaaggaaatgaaattaaagaaagcaatgctcggatagtcaagtggtcagatggaagcatgtccctgcatttaggcaatgaagtgtttgatgtgtacaaagccccactgcagggcgaccacaatcatctttttataagacaaggtactggtctacagggacaagcagtctttaaaacgaaactcaccttcagacctcactctacggacagtgccacacatagaaagatgactctgtcacttgcagataggtgttcaaagacacagaagattagaatcttgccaatggctggtcgtgatcctgaatgccaacgcacagaaatgattaagaaagaagaagaacgtttgagggcttccatacgtagggaatctcagcagcgccgaatgagagagaaacagcaccagcgggggctgagcgccagttacctggaacctgatcgatacgatgaggaggaggaaggcgaggagtccatcagcttggctgccattaaaaaccgatataaagggggcattcgagaggaacgagccagaatctattcatcagacagtgatgagggatcagaagaagataaagctcaaagattactcaaagcaaagaaacttaccagtgatgaggaaggtgaaccttccggaaagagaaaagcagaagatgatgataaagcaaataaaaagcataagaagtatgtgatcagcgatgaagaggaagaagatgatgattgaagtatgaaatatgaaaacattttatatattttattgtacagttataaatatgtaaacatgagttattttgattgaaatgaatcgatttgcttttgtgtaattttaattgtaataaaacaatttaaaagcaaatc

SEQ ID NO: 355621 - DNA, 1239 bp, Homo sapiens
  misc_feature (1229)..(1229): n is a, c, g, or t
gcccctaaccgaggcagcagcggacgtgagcgataatggcggatatggaggatctcttcgggagcgacgccgacagcgaagctgagcgtaaagattctgattctggatctgactcagattctgatcaagagaatgctgcctctggcagtaatgcctctggaagtgaaagtgatcaggatgaaagaggtgattcaggacaaccaagtaataaggaactgtttggagatgacagtgaggacgagggagcttcacatcatagtggtagtgataatcactctgaaagatcagacaatagatcagaagcttctgagcgttctgaccatgaggacaatgacccctcagatgtagatcagcacagtggatcagaagcccctaatgatgatgaagacgaaggtcatagatcggatggagggagccatcattcagaagcagaaggttctgaaaaagcacattcagatgatgaaaaatggggcagagaagataaaagtgaccagtcagatgatgaaaagatacaaaattctgatgatgaggagagggcacaaggatctgatgaagataagctgcagaattctgacgatgatgagaaaatgcagaacacagatgatgaggagaggcctcagctttccgatgatgagagacaacagctatctgaggaggaaaaggctaattctgatgatgaacggccggtagcttctgataatgatgatgagaaacagaattctgatgatgaagaacaaccacagctgtctgatgaagagaaaatgcaaaattctgatgatgaaaggccacaggcctcagatgaagaacacaggcattcagatgatgaagaggaacaggatcataaatcaggtaatacatttatgagaaccagaatggctcagaaagaagcattcagatacagcagggacccatttagtctttattcccatctttattaccctgttttttctcttctgtcccctccctttcaaacttttctaactctagaatacattttgcttcttttaaatctttctaatccacttattctttcttactcctttcccttccatttgttaatggataggtctgggggaaaacaatttaaagaggacttaaaattgagtcttagagggagggatatggtgtaagaagagctgataatgagttaagttgattccatttctgtggataactgaagagcatgcctcatgtgagagaatagattagcctggggagctccaagcctntagggtacca

SEQ ID NO: 355622 - DNA, 1890 bp, Homo sapiens
tgtgtgtgtgtgtgtattttttttttgcccagagtctcactctgttgcccaagctggagtgcaatggtgtggccttggctcattgcaacctctgcctcccgggttcaagcaattcccctgcctcagcctcccaagtagctgggattacaggcacctgtcaccaagcccagctaatttttgtatttttagtagagacggggtttcaccatgttggtcaggctggtgtcaaactcctgaccttaagtgatccacctgccttggcctcccaaagtgctgggattacaggcatgaaccactgtgcctggactgtaattttgaatctgggatagacttatggaaaatgggtgtctgtggagtgcttcagccccaactttgagcatctagactgtaggaaacatttgggctcctggggaataaaggaaagtgggagaacaaggatggtgaaaatgaaaggagaaataagtgcctcctgtgcagcttgcctttcactagatttgcccccttccctctccccacactctctggttgggtctttgagagccaggctcagcattatgtttttggtggttttctgatgctggtccagaaaccttgggaatgtgttgaagtgatcagctgtgaagaaccttagttacagatagtaacactaatgcctttttccttctgcattgaagataatagtggaaccatggatttatttggaggtgcagatgatatctcttcagggagtgatggagaagacaaaccacctactccaggacagcctgttgatgaaaatggattgcctcaggatcaacaggaagaggagccaattcctgagaccagaatagaagtagaaatacccaaagtaaacactgatttaggaaacgacttatattttgttaaactgcccaactttctcagtgtagagcccagaccttttgatcctcagtattatgaagatgaatttgaagatgaagaaatgctggatgaagaaggtagaaccaggttaaaattaaaggtagaaaatactataagatggaggatacgccgagatgaagaaggaaatgaaattaaagaaagcaatgctcggatagtcaagtggtcagatggaagcatgtccctgcatttaggcaatgaagtgtttgatgtgtacaaagccccactgcagggcgaccacaatcatctttttataagacaaggtactggtctacagggacaagcagtctttaaaacgaaactcaccttcagacctcactctacggacagtgccacacatagaaagatgactctgtcacttgcagataggtgttcaaagacacagaagattagaatcttgccaatggctggtcgtgatcctgaatgccaacgcacagaaatgattaagaaagaagaagaacgtttgagggcttccatacgtagggaatctcagcagcgccgaatgagagagaaacagcaccagcgggggctgagcgccagttacctggaacctgatcgatacgatgaggaggaggaaggcgaggagtccatcagcttggctgccattaaaaaccgatataaagggggcattcgagaggaacgagccagaatctattcatcagacagtgatgagggatcagaagaagataaagctcaaagattactcaaagcaaagaaacttaccagtgatgaggaaggtgaaccttccggaaagagaaaagcagaagatgatgataaagcaaataaaaagcataagaagtatgtgatcagcgatgaagaggaagaagatgatgattgaagtatgaaatatgaaaacattttatatattttattgtacagttataaatatgtaaacatgagttattttgattgaaatgaatcgatttgcttttgtgtaattttaattgtaataaaacaatttaaaagcaaatc

SEQ ID NO: 355623 - DNA, 1229 bp, Homo sapiens
tgtgttcttcatctgaggcctgtggcctttcatcatcagaattttgcattttctcttcatcagacagctgtggttgttcttcatcatcagaattctgtgtctcatcatcattatcagaagctaccggccgttcatcatcagaattagccaattcctgagaccagaatagaagtagaaatacccaaagtaaacactgatttaggaaacgacttatattttgttaaactgcccaactttctcagtgtagagcccagaccttttgatcctcagtattatgaagatgaatttgaagatgaagaaatgctggatgaagaaggtagaaccaggttaaaattaaaggtagaaaatactataagatggaggatacgccgagatgaagaaggaaatgaaattaaagaaagcaatgctcggatagtcaagtggtcagatggaagcatgtccctgcatttaggcaatgaagtgtttgatgtgtacaaagccccactgcagggcgaccacaatcatctttttataagacaaggtactggtctacagggacaagcagtctttaaaacgaaactcaccttcagacctcactctacggacagtgccacacatagaaagatgactctgtcacttgcagataggtgttcaaagacacagaagattagaatcttgccaatggctggtcgtgatcctgaatgccaacgcacagaaatgattaagaaagaagaagaacgtttgagggcttccatacgtagggaatctcagcagcgccgaatgagagagaaacagcaccagcgggggctgagcgccagttacctggaacctgatcgatacgatgaggaggaggaaggcgaggagtccatcagcttggctgccattaaaaaccgatataaagggggcattcgagaggaacgagccagaatctattcatcagacagtgatgagggatcagaagaagataaagctcaaagattactcaaagcaaagaaacttaccagtgatgaggaaggtgaaccttccggaaagagaaaagcagaagatgatgataaagcaaataaaaagcataagaagtatgtgatcagcgatgaagaggaagaagatgatgattgaagtatgaaatatgaaaacattttatatattttattgtacagttataaatatgtaaacatgagttattttgattgaaatgaatcgatttgcttttgtgtaattttaattgtaataaaacaatttaaaagcaaatc

SEQ ID NO: 355624 - DNA, 1044 bp, Homo sapiens
tgtgtgtgtgtgtgtattttttttttgcccagagtctcactctgttgcccaagctggagtgcaatggtgtggccttggctcattgcaacctctgcctcccgggttcaagcaattcccctgcctcagcctcccaagtagctgggattacaggcacctgtcaccaagcccagctaatttttgtatttttagtagagacggggtttcaccatgttggtcaggctggtgtcaaactcctgaccttaagtgatccacctgccttggcctcccaaagtgctgggattacaggcatgaaccactgtgcctggactgtaattttgaatctgggatagacttatggaaaatgggtgtctgtggagtgcttcagccccaactttgagcatctagactgtaggaaacatttgggctcctggggaataaaggaaagtgggagaacaaggatggtgaaaatgaaaggagaaataagtgcctcctgtgcagcttgcctttcactagatttgcccccttccctctccccacactctctggttgggtctttgagagccaggctcagcattatgtttttggtggttttctgatgctggtccagaaaccttgggaatgtgttgaagtgatcagctgtgaagaaccttagttacagatagtaacactaatgcctttttccttctgcattgaagataatagtggaaccatggatttatttggaggtgcagatgatatctcttcagggagtgatggagaagacaaaccacctactccaggacagcctgttgtaagtcagttagtaacatgaacttattcaaggccaagcataaagtttcaaaggtgaagagtctcccttattctaggaaaggaagttgataactgaattctagtatgaaaataccatgaacagatgactttcttcattatgtagggaactcttggttataagggggagtggaaataactgccaaacatgaggttggtgtcatgccttaggggactgaactgtgaggacttgtgatttgagaaccattgacttgaatgtttttcttgctcatgcca

SEQ ID NO: 355625 - DNA, 551 bp, Homo sapiens
gtttatagatgccctttaatgtcatcaaatattttcttaaaaacctttatgatgtttttaatgcattgaaacaaattgttccaaaaaaaccaaatcaacagtctttaaaatactgaattttagataatgaaaagaagtgaaatgctgaggaggcagagaaaaaaaatttgagaaattacctgatcatggtaaaaatatcctgacaggaccagtggttagacaggcagaacttcctcgggagagccccaccccttctgtggcaaatcctgtctccagtttcctgcacatcctactctgtgttcaaaggtttccctgtgagagattagttcacagttgctgacacctcacaatctccctcacaacctgcaggaaccgttactttgagttgtcagagggtcattcagctcatagctacttttcataaaccatcctaaaaatgttctttattgacttgtagatttgtaaaaattgtatctgtttaggaaggtgaaccttccggaaagagaaaagcagaagatgatgataaagcaaataaaaagcataagaagtat

SEQ ID NO: 355626 - DNA, 2272 bp, Homo sapiens
gcccctaaccgaggcagcagcggacgtgagcgataatggcggatatggaggatctcttcgggagcgacgccgacagcgaagctgagcgtaaagattctgattctggatctgactcagattctgatcaagagaatgctgcctctggcagtaatgcctctggaagtgaaagtgatcaggatgaaagaggtgattcaggacaaccaagtaataaggaactgtttggagatgacagtgaggacgagggagcttcacatcatagtggtagtgataatcactctgaaagatcagacaatagatcagaagcttctgagcgttctgaccatgaggacaatgacccctcagatgtagatcagcacagtggatcagaagcccctaatgatgatgaagacgaaggtcatagatcggatggagggagccatcattcagaagcagaaggttctgaaaaagcacattcagatgatgaaaaatggggcagagaagataaaagtgaccagtcagatgatgaaaagatacaaaattctgatgatgaggagagggcacaaggatctgatgaagataagctgcagaattctgacgatgatgagaaaatgcagaacacagatgatgaggagaggcctcagctttccgatgatgagagacaacagctatctgaggaggaaaaggctaattctgatgatgaacggccggtagcttctgataatgatgatgagaaacagaattctgatgatgaagaacaaccacagctgtctgatgaagagaaaatgcaaaattctgatgatgaaaggccacaggcctcagatgaagaacacaggcattcagatgatgaagaggaacaggatcataaatcagaatctgcaagaggcagtgatagtgaagatgaagttttacgaatgaaacgcaagaatgcgattgcatctgattcagaagcggatagtgacactgaggtgccaaaagataatagtggaaccatggatttatttggaggtgcagatgatatctcttcagggagtgatggagaagacaaaccacctactccaggacagcctgttgatgaaaatggattgcctcaggatcaacaggaagaggagccaattcctgagaccagaatagaagtagaaatacccaaagtaaacactgatttaggaaacgacttatattttgttaaactgcccaactttctcagtgtagagcccagaccttttgatcctcagtattatgaagatgaatttgaagatgaagaaatgctggatgaagaaggtagaaccaggttaaaattaaaggtagaaaatactataagatggaggatacgccgagatgaagaaggaaatgaaattaaagaaagcaatgctcggatagtcaagtggtcagatggaagcatgtccctgcatttaggcaatgaagtgtttgatgtgtacaaagccccactgcagggcgaccacaatcatctttttataagacaaggtactggtctacagggacaagcagtctttaaaacgaaactcaccttcagacctcactctacggacagtgccacacatagaaagatgactctgtcacttgcagataggtgttcaaagacacagaagattagaatcttgccaatggctggtcgtgatcctgaatgccaacgcacagaaatgattaagaaagaagaagaacgtttgagggcttccatacgtagggaatctcagcagcgccgaatgagagagaaacagcaccagcgggggctgagcgccagttacctggaacctgatcgatacgatgaggaggaggaaggcgaggagtccatcagcttggctgccattaaaaaccgatataaagggggcattcgagaggaacgagccagaatctattcatcagacagtgatgagggatcagaagaagataaagctcaaagattactcaaagcaaagaaacttaccagtgatgaggaaggtgaccttccggaagagaaacgcagagatgctgatacgcacatacaagcatacgaagtatgtgaccacaaacaaacaaaacaaacaaaaactagacgcgcagcatggcagagaagtataagaccaccggtgggccgggcccatagaatgccagtgcaacgtgtcccacgaccccgagatcaggtgggtccacaaaaaacccgcgaccgcggtacacacgtgacgagtcaaggcaacaaacagccggaaaagccacggtggagagaacaacgtatcagacatcacagaaccgagacacaataggaaaaaagaaggagataacggacacaccaacattg

SEQ ID NO: 355627 - DNA, 2040 bp, Homo sapiens
actcccaacggctcctttctcttctcttagcagcacccagcttgcccacccatgctcaagatgggcgggatgccagcctgttacataaatgtgccaaaagcctggccatgcctggaaaatggaccaatccgcccgccaagaggttgggtctcgttccctagagagaaggaagtttcctctccttgaagtgagagctagaatcgcactttctgtcaagctgagagaaagactcttttccagaggctaaaaggacaagaaaatctgatttgcttgcttctaactttgcgttttaaagggggaaggaggaaaggaaagagggggagggtggttctgcttagccccacccctccggctaccccaggtccagccgtccattccggtggaggcagaggcagtcctggggctctggggctcgggctttgtcaccgggacccgcaggagccagaaccactcggcgccgcctggtgcatgggaggggagccgggccaggagtaagtaactcatacgggcgccggggacccgggtcgggctgggggcttccaactcagagggagtgtgatttgcctgatcctcttcggcgttgtcctgctctgccgcatccagccctgtaccgccatcccacttcccgccgttcccatctgtgttccgggtgggatcggtctggaggcggccgaggacttcccaggcaggagctcggggcggaggccgggtccgcggcagaccagggcagcgaggcgctggccggcagggggcgctgcggtgccagcctgaggctgggctgctccgcgaggatacagcggcccctgccctgtcctgtcctgccctgccctgtcctgtcctgccctgccctgccctgtcctgtcctgccctgccctgccctgtgtcctcagacaatatgttagccgtgcactttgacaagccgggaggaccggaaaacctctacgtgaaggaggtggccaagccgagcccgggggagggtgaagtcctcctgaaggtggcggccagcgccctgaaccgggcggacttaatgcagagacaaggccagtatgacccacctccaggagccagcaacattttgggacttgaggcatctggacatgtggcagagctggggcctggctgccagggacactggaagatcggggacacagccatggctctgctccccggtgggggccaggctcagtacgtcactgtccccgaagggctcctcatgcctatcccagagggattgaccctgacccaggctgcagccatcccagaggcctggctcaccgccttccagctgttacatcttgtgggaaatgttcaggctggagactatgtgctaatccatgcaggactgagtggtgtgggcacagctgctatccaactcacccggatggctggagctattcctctggtcacagctggctcccagaagaagcttcaaatggcagaaaagcttggagcagctgctggattcaattacaaaaaagaggatttctctgaagcaacgctgaaattcaccaaaggtgctggagttaatcttattctagactgcataggcggatcctactgggagaagaacgtcaactgcctggctcttgatggtcgatgggttctctatggtctgatgggaggaggtgacatcaatgggcccctgttttcaaagctactttttaagcgaggaagtctgatcaccagtttgctgaggtctagggacaataagtacaagcaaatgctggtgaatgctttcacggagcaaattctgcctcacttctccacggagggcccccaacgtctgctgccggttctggacagaatctacccagtgaccgaaatccaggaggcccataagtacatggaggccaacaagaacataggcaagatcgtcctggaactgccccagtgaaggaggatggggcaggacaggacgcggccaccccaggcctttccagagcaaacctggagaagattcacaatagacaggccaagaaacccggtgcttcctccagagccgtttaaagctgatatgaggaaataaagagtgaactggaa

SEQ ID NO: 355628 - DNA, 1766 bp, Homo sapiens
actcccaacggctcctttctcttctcttagcagcacccagcttgcccacccatgctcaagatgggcgggatgccagcctgttacataaatgtgccaaaagcctggccatgcctggaaaatggaccaatccgcccgccaagaggttgggtctcgttccctagagagaaggaagtttcctctccttgaagtgagagctagaatcgcactttctgtcaagctgagagaaagactcttttccagaggctaaaaggacaagaaaatctgatttgcttgcttctaactttgcgttttaaagggggaaggaggaaaggaaagagggggagggtggttctgcttagccccacccctccggctaccccaggtccagccgtccattccggtggaggcagaggcagtcctggggctctggggctcgggctttgtcaccgggacccgcaggagccagaaccactcggcgccgcctggtgcatgggaggggagccgggccaggaacaatatgttagccgtgcactttgacaagccgggaggaccggaaaacctctacgtgaaggaggtggccaagccgagcccgggggagggtgaagtcctcctgaaggtggcggccagcgccctgaaccgggcggacttaatgcagagacaaggccagtatgacccacctccaggagccagcaacattttgggacttgaggcatctggacatgtggcagagctggggcctggctgccagggacactggaagatcggggacacagccatggctctgctccccggtgggggccaggctcagtacgtcactgtccccgaagggctcctcatgcctatcccagagggattgaccctgacccaggctgcagccatcccagaggcctggctcaccgccttccagctgttacatcttgtgggaaatgttcaggctggagactatgtgctaatccatgcaggactgagtggtgtgggcacagctgctatccaactcacccggatggctggagctattcctctggtcacagctggctcccagaagaagcttcaaatggcagaaaagcttggagcagctgctggattcaattacaaaaaagaggatttctctgaagcaacgctgaaattcaccaaaggtgctggagttaatcttattctagactgcataggcggatcctactgggagaagaacgtcaactgcctggctcttgatggtcgatgggttctctatggtctgatgggaggaggtgacatcaatgggcccctgttttcaaagctactttttaagcgaggaagtctgatcaccagtttgctgaggtctagggacaataagtacaagcaaatgctggtgaatgctttcacggagcaaattctgcctcacttctccacggagggcccccaacgtctgctgccggttctggacagaatctacccagtgaccgaaatccaggaggcccataagtacatggaggccaacaagaacataggcaagatcgtcctggaactgccccagtgaaggaggatggggcaggacaggacgcggccaccccaggcctttccagagcaaacctggagaagattcacaatagacaggccaagaaacccggtgcttcctccagagccgtttaaagctgatatgaggaaataaagagtgaactggaaaccacccccacaccaaaaacaacacgcgggtctcggggggcgacacagggcacaagggcaggccaggggcgcgcccgtttcggaaaggggacggggggccaaaggggggaaaagaacccgcccac

SEQ ID NO: 355629 - DNA, 2015 bp, Homo sapiens
actcccaacggctcctttctcttctcttagcagcacccagcttgcccacccatgctcaagatgggcgggatgccagcctgttacataaatgtgccaaaagcctggccatgcctggaaaatggaccaatccgcccgccaagaggttgggtctcgttccctagagagaaggaagtttcctctccttgaagtgagagctagaatcgcactttctgtcaagctgagagaaagactcttttccagaggctaaaaggacaagaaaatctgatttgcttgcttctaactttgcgttttaaagggggaaggaggaaaggaaagagggggagggtggttctgcttagccccacccctccggctaccccaggtccagccgtccattccggtggaggcagaggcagtcctggggctctggggctcgggctttgtcaccgggacccgcaggagccagaaccactcggcgccgcctggtgcatgggaggggagccgggccaggagtaagtaactcatacgggcgccggggacccgggtcgggctgggggcttccaactcagagggagtgtgatttgcctgatcctcttcggcgttgtcctgctctgccgcatccagccctgtaccgccatcccacttcccgccgttcccatctgtgttccgggtgggatcggtctggaggcggccgaggacttcccaggcaggagctcggggcggaggccgggtccgcggcagaccagggcagcgaggcgctggccggcagggggcgctgcggtgccagcctgaggctgggctgctccgcgaggatacagcggcccctgccctgtcctgtcctgccctgccctgtcctgtcctgccctgccctgccctgtgtcctcagacaatatgttagccgtgcactttgacaagccgggaggaccggaaaacctctacgtgaaggaggtggccaagccgagcccgggggagggtgaagtcctcctgaaggtggcggccagcgccctgaaccgggcggacttaatgcagagacaaggccagtatgacccacctccaggagccagcaacattttgggacttgaggcatctggacatgtggcagagctggggcctggctgccagggacactggaagatcggggacacagccatggctctgctccccggtgggggccaggctcagtacgtcactgtccccgaagggctcctcatgcctatcccagagggattgaccctgacccaggctgcagccatcccagaggcctggctcaccgccttccagctgttacatcttgtgggaaatgttcaggctggagactatgtgctaatccatgcaggactgagtggtgtgggcacagctgctatccaactcacccggatggctggagctattcctctggtcacagctggctcccagaagaagcttcaaatggcagaaaagcttggagcagctgctggattcaattacaaaaaagaggatttctctgaagcaacgctgaaattcaccaaaggtgctggagttaatcttattctagactgcataggcggatcctactgggagaagaacgtcaactgcctggctcttgatggtcgatgggttctctatggtctgatgggaggaggtgacatcaatgggcccctgttttcaaagctactttttaagcgaggaagtctgatcaccagtttgctgaggtctagggacaataagtacaagcaaatgctggtgaatgctttcacggagcaaattctgcctcacttctccacggagggcccccaacgtctgctgccggttctggacagaatctacccagtgaccgaaatccaggaggcccataagtacatggaggccaacaagaacataggcaagatcgtcctggaactgccccagtgaaggaggatggggcaggacaggacgcggccaccccaggcctttccagagcaaacctggagaagattcacaatagacaggccaagaaacccggtgcttcctccagagccgtttaaagctgatatgaggaaataaagagtgaactggaa

SEQ ID NO: 355630 - DNA, 1602 bp, Homo sapiens
actcccaacggctcctttctcttctcttagcagcacccagcttgcccacccatgctcaagatgggcgggatgccagcctgttacataaatgtgccaaaagcctggccatgcctggaaaatggaccaatccgcccgccaagaggttgggtctcgttccctagagagaaggaagtttcctctccttgaagtgagagctagaatcgcactttctgtcaagctgagagaaagactcttttccagaggctaaaaggacaagaaaatctgatttgcttgcttctaactttgcgttttaaagggggaaggaggaaaggaaagagggggagggtggttctgcttagccccacccctccggctaccccaggtccagccgtccattccggtggaggcagaggcagtcctggggctctggggctcgggctttgtcaccgggacccgcaggagccagaaccactcggcgccgcctggtgcatgggaggggagccgggccaggaacaatatgttagccgtgcactttgacaagccgggaggaccggaaaacctctacgtgaaggaggtggccaagccgagcccgggggagggtgaagtcctcctgaaggtggcggccagcgccctgaaccgggcggacttaatgcagagacaaggccagtatgacccacctccaggagccagcaacattttgggacttgaggcatctggacatgtggcagagctggggcctggctgccagggacactggaagatcggggacacagccatggctctgctccccggtgggggccaggctcagtacgtcactgtccccgaagggctcctcatgcctatcccagagggattgaccctgacccaggctgcagccatcccagaggcctggctcaccgccttccagctgttacatcttgtgggactgagtggtgtgggcacagctgctatccaactcacccggatggctggagctattcctctggtcacagctggctcccagaagaagcttcaaatggcagaaaagcttggagcagctgctggattcaattacaaaaaagaggatttctctgaagcaacgctgaaattcaccaaaggtgctggagttaatcttattctagactgcataggcggatcctactgggagaagaacgtcaactgcctggctcttgatggtcgatgggttctctatggtctgatgggaggaggtgacatcaatgggcccctgttttcaaagctactttttaagcgaggaagtctgatcaccagtttgctgaggtctagggacaataagtacaagcaaatgctggtgaatgctttcacggagcaaattctgcctcacttctccacggagggcccccaacgtctgctgccggttctggacagaatctacccagtgaccgaaatccaggaggcccataagtacatggaggccaacaagaacataggcaagatcgtcctggaactgccccagtgaaggaggatggggcaggacaggacgcggccaccccaggcctttccagagcaaacctggagaagattcacaatagacaggccaagaaacccggtgcttcctccagagccgtttaaagctgatatgaggaaataaagagtgaactggaa

SEQ ID NO: 355631 - DNA, 1444 bp, Homo sapiens
actcccaacggctcctttctcttctcttagcagcacccagcttgcccacccatgctcaagatgggcgggatgccagcctgttacataaatgtgccaaaagcctggccatgcctggaaaatggaccaatccgcccgccaagaggttgggtctcgttccctagagagaaggaagtttcctctccttgaagtgagagctagaatcgcactttctgtcaagctgagagaaagactcttttccagaggctaaaaggacaagaaaatctgatttgcttgcttctaactttgcgttttaaagggggaaggaggaaaggaaagagggggagggtggttctgcttagccccacccctccggctaccccaggtccagccgtccattccggtggaggcagaggcagtcctggggctctggggctcgggctttgtcaccgggacccgcaggagccagaaccactcggcgccgcctggtgcatgggaggggagccgggccaggaacaatatgttagccgtgcactttgacaagccgggaggaccggaaaacctctacgtgaaggaggtggccaagccgagcccgggggagggtgaagtcctcctgaaggtggcggccagcgccctgaaccgggcggacttaatgcagagacaaggccagtatgacccacctccaggagccagcaacattttgggacttgaggcatctggacatgtggcagagctggggcctggctgccagggacactggaagatcggggacacagccatggctctgctccccggtgggggccaggctcagtacgtcactgtccccgaagggctcctcatgcctatcccagagggattgaccctgacccaggctgcagccatcccagaggcctggctcaccgccttccagctgttacatcttgtgggaaatgttcaggctggagactatgtgctaatccatgcaggactgagtggtgtgggcacagctgctatccaactcacccggatggctggagctattcctctggtcacagctggctcccagaagaagcttcaaatggcagaaaagcttggagcagctgctggattcaattacaaaaaagaggatttctctgaagcaacgctgaaattcaccaaagtacaagcaaatgctggtgaatgctttcacggagcaaattctgcctcacttctccacggagggcccccaacgtctgctgccggttctggacagaatctacccagtgaccgaaatccaggaggcccataagtacatggaggccaacaagaacataggcaagatcgtcctggaactgccccagtgaaggaggatggggcaggacaggacgcggccaccccaggcctttccagagcaaacctggagaagattcacaatagacaggccaagaaacccggtgcttcctccagagccgtttaaagctgatatgaggaaataaagagtgaactggaa

SEQ ID NO: 355632 - DNA, 1568 bp, Homo sapiens
actcccaacggctcctttctcttctcttagcagcacccagcttgcccacccatgctcaagatgggcgggatgccagcctgttacataaatgtgccaaaagcctggccatgcctggaaaatggaccaatccgcccgccaagaggttgggtctcgttccctagagagaaggaagtttcctctccttgaagtgagagctagaatcgcactttctgtcaagctgagagaaagactcttttccagaggctaaaaggacaagaaaatctgatttgcttgcttctaactttgcgttttaaagggggaaggaggaaaggaaagagggggagggtggttctgcttagccccacccctccggctaccccaggtccagccgtccattccggtggaggcagaggcagtcctggggctctggggctcgggctttgtcaccgggacccgcaggagccagaaccactcggcgccgcctggtgcatgggaggggagccgggccaggagtaagtaactcatacgggcgccggggacccgggtcgggctgggggcttccaactcagagggagtgtgatttgcctgatcctcttcggcgttgtcctgctctgccgcatccagccctgtaccgccatcccacttcccgccgttcccatctgtgttccgggtgggatcggtctggaggcggccgaggacttcccaggcaggagctcggggcggaggccgggtccgcggcagaccagggcagcgaggcgctggccggcagggggcgctgcggtgccagcctgaggctgggctgctccgcgaggatacagcggcccctgccctgtcctgtcctgccctgccctgtcctgtcctgccctgccctgccctgtgtcctcagacaatatgttagccgtgcactttgacaagccgggaggaccggaaaacctctacgtgaaggaggtggccaagccgagcccgggggagggtgaagtcctcctgaaggtggcggccagcgccctgaaccgggcggacttaatgcagagacaaggccagtatgacccacctccaggagccagcaacattttgggacttgaggcatctggacatgtggcagagctggggcctggctgccagggacactggaagatcggggacacagccatggctctgctccccggtgggggccaggctcagtacgtcactgtccccgaagggctcctcatgcctatcccagagggattgaccctgacccaggctgcagccatcccagaggcctggctcaccgccttccagctgttacatcttgtgggaaatgttcaggctggagactatgtgctaatccatgcaggactgagtggtgtgggcacagctgctatccaactcacccggatggctggagctattcctctggtcacagctggctcccagaagaagcttcaaatggcagaaaagcttggagcagctgctggattcaattacaaaaaagaggatttctctgaagcaacgctgaaattcaccaaaggtaaacaactgcttctacagttcagcaggaatttaagagatgattaaataaaagccccaccagtctcaaagttgccagt

SEQ ID NO: 355633 - DNA, 1641 bp, Homo sapiens
actcccaacggctcctttctcttctcttagcagcacccagcttgcccacccatgctcaagatgggcgggatgccagcctgttacataaatgtgccaaaagcctggccatgcctggaaaatggaccaatccgcccgccaagaggttgggtctcgttccctagagagaaggaagtttcctctccttgaagtgagagctagaatcgcactttctgtcaagctgagagaaagactcttttccagaggctaaaaggacaagaaaatctgatttgcttgcttctaactttgcgttttaaagggggaaggaggaaaggaaagagggggagggtggttctgcttagccccacccctccggctaccccaggtccagccgtccattccggtggaggcagaggcagtcctggggctctggggctcgggctttgtcaccgggacccgcaggagccagaaccactcggcgccgcctggtgcatgggaggggagccgggccaggaacaatatgttagccgtgcactttgacaagccgggaggaccggaaaacctctacgtgaaggaggtggccaagccgagcccgggggagggtgaagtcctcctgaaggtggcggccagcgccctgaaccgggcggacttaatgcagagacaaggccagtatgacccacctccaggagccagcaacattttgggacttgaggcatctggacatgtggcagagctggggcctggctgccagggacactggaagatcggggacacagccatggctctgctccccggtgggggccaggctcagtacgtcactgtccccgaagggctcctcatgcctatcccagagggattgaccctgacccaggctgcagccatcccagaggcctggctcaccgccttccagctgttacatcttgtgggaaatgttcaggctggagactatgtgctaatccatgcaggactgagtggtgtgggcacagctgctatccaactcacccggatggctggagctattcctctggtcacagctggctcccagaagaagcttcaaatggcagaaaagcttggagcagctgctggattcaattacaaaaaagaggatttctctgaagcaacgctgaaattcaccaaaggtgctggagttaatcttattctagactgcataggcggatcctactgggagaagaacgtcaactgcctggctcttgatggtcgatgggttctctatggtctgatgggaggaggtgacatcaatgggcccctgttttcaaagctactttttaagcgaggaagtctgatcaccagtttgctgaggtctagggacaataagtacaagcaaatgctggtgaatgctttcacggagcaaattctgcctcacttctccacggagggcccccaacgtctgctgccggttctggacagaatctacccagtgaccgaaatccaggaggcccataagtacatggaggccaacaagaacataggcaagatcgtcctggaactgccccagtgaaggaggatggggcaggacaggacgcggccaccccaggcctttccagagcaaacctggagaagattcacaatagacaggccaagaaacccggtgcttcctccagagccgtttaaagctgatatgaggaaataaagagtgaactggaa

SEQ ID NO: 355634 - DNA, 1467 bp, Homo sapiens
actcccaacggctcctttctcttctcttagcagcacccagcttgcccacccatgctcaagatgggcgggatgccagcctgttacataaatgtgccaaaagcctggccatgcctggaaaatggaccaatccgcccgccaagaggttgggtctcgttccctagagagaaggaagtttcctctccttgaagtccagccgtccattccggtggaggcagaggcagtcctggggctctggggctcgggctttgtcaccgggacccgcaggagccagaaccactcggcgccgcctggtgcatgggaggggagccgggccaggaacaatatgttagccgtgcactttgacaagccgggaggaccggaaaacctctacgtgaaggaggtggccaagccgagcccgggggagggtgaagtcctcctgaaggtggcggccagcgccctgaaccgggcggacttaatgcagagacaaggccagtatgacccacctccaggagccagcaacattttgggacttgaggcatctggacatgtggcagagctggggcctggctgccagggacactggaagatcggggacacagccatggctctgctccccggtgggggccaggctcagtacgtcactgtccccgaagggctcctcatgcctatcccagagggattgaccctgacccaggctgcagccatcccagaggcctggctcaccgccttccagctgttacatcttgtgggaaatgttcaggctggagactatgtgctaatccatgcaggactgagtggtgtgggcacagctgctatccaactcacccggatggctggagctattcctctggtcacagctggctcccagaagaagcttcaaatggcagaaaagcttggagcagctgctggattcaattacaaaaaagaggatttctctgaagcaacgctgaaattcaccaaaggtgctggagttaatcttattctagactgcataggcggatcctactgggagaagaacgtcaactgcctggctcttgatggtcgatgggttctctatggtctgatgggaggaggtgacatcaatgggcccctgttttcaaagctactttttaagcgaggaagtctgatcaccagtttgctgaggtctagggacaataagtacaagcaaatgctggtgaatgctttcacggagcaaattctgcctcacttctccacggagggcccccaacgtctgctgccggttctggacagaatctacccagtgaccgaaatccaggaggcccataagtacatggaggccaacaagaacataggcaagatcgtcctggaactgccccagtgaaggaggatggggcaggacaggacgcggccaccccaggcctttccagagcaaacctggagaagattcacaatagacaggccaagaaacccggtgcttcctccagagccgtttaaagctgatatgaggaaataaagagtgaactggaa

SEQ ID NO: 355635 - DNA, 1428 bp, Homo sapiens
actcccaacggctcctttctcttctcttagcagcacccagcttgcccacccatgctcaagatgggcgggatgccagcctgttacataaatgtgccaaaagcctggccatgcctggaaaatggaccaatccgcccgccaagaggttgggtctcgttccctagagagaaggaagtttcctctccttgaagtgagagctagaatcgcactttctgtcaagctgagagaaagactcttttccagaggctaaaaggacaagaaaatctgatttgcttgcttctaactttgcgttttaaagggggaaggaggaaaggaaagagggggagggtggttctgcttagccccacccctccggctaccccaggtccagccgtccattccggtggaggcagaggcagtcctggggctctggggctcgggctttgtcaccgggacccgcaggagccagaaccactcggcgccgcctggtgcatgggaggggagccgggccaggaacaatatgttagccgtgcactttgacaagccgggaggaccggaaaacctctacgtgaaggaggtggccaagccgagcccgggggagggtgaagtcctcctgaaggtggcggccagcgccctgaaccgggcggacttaatgcagagacaaggccagtatgacccacctccaggagccagcaacattttgggacttgaggcatctggacatgtggcagagctggggcctggctgccagggacactggaagatcggggacacagccatggctctgctccccggtgggggccaggctcagtacgtcactgtccccgaagggctcctcatgcctatcccagagggattgaccctgacccaggctgcagccatcccagaggcctggctcaccgccttccagctgttacatcttgtgggtgctggagttaatcttattctagactgcataggcggatcctactgggagaagaacgtcaactgcctggctcttgatggtcgatgggttctctatggtctgatgggaggaggtgacatcaatgggcccctgttttcaaagctactttttaagcgaggaagtctgatcaccagtttgctgaggtctagggacaataagtacaagcaaatgctggtgaatgctttcacggagcaaattctgcctcacttctccacggagggcccccaacgtctgctgccggttctggacagaatctacccagtgaccgaaatccaggaggcccataagtacatggaggccaacaagaacataggcaagatcgtcctggaactgccccagtgaaggaggatggggcaggacaggacgcggccaccccaggcctttccagagcaaacctggagaagattcacaatagacaggccaagaaacccggtgcttcctccagagccgtttaaagctgatatgaggaaataaagagtgaactggaa

SEQ ID NO: 355636 - DNA, 1194 bp, Homo sapiens
actcccaacggctcctttctcttctcttagcagcacccagcttgcccacccatgctcaagatgggcgggatgccagcctgttacataaatgtgccaaaagcctggccatgcctggaaaatggaccaatccgcccgccaagaggttgggtctcgttccctagagagaaggaagtttcctctccttgaagtgagagctagaatcgcactttctgtcaagctgagagaaagactcttttccagaggctaaaaggacaagaaaatctgatttgcttgcttctaactttgcgttttaaagggggaaggaggaaaggaaagagggggagggtggttctgcttagccccacccctccggctaccccaggtccagccgtccattccggtggaggcagaggcagtcctggggctctggggctcgggctttgtcaccgggacccgcaggagccagaaccactcggcgccgcctggtgcatgggaggggagccgggccaggaacaatatgttagccgtgcactttgacaagccgggaggaccggaaaacctctacgtgaaggaggtggccaagccgagcccgggggagggtgaagtcctcctgaaggtggcggccagcgccctgaaccgggcggacttaatgcagagacaaggccagtatgacccacctccaggagccagcaacattttgggacttgaggcatctggacatgtggcagagctggggcctggctgccagggacactggaagatcggggacacagccatggctctgctccccggtgggggccaggctcagtacgtcactgtccccgaagggctcctcatgcctatcccagagggattgaccctgacccaggctgcagccatcccagaggcctggctcaccgccttccagctgttacatcttgtgggaaatgttcaggctggagactatgtgctaatccatgcaggactgagtggtgtgggcacagctgctatccaactcacccggatggctggagctattcctctggtcacagctggctcccagaagaagcttcaaatggcagaaaagcttggagcagctgctggattcaattacaaaaaagaggatttctctgaagcaacgctgaaattcaccaaaggtaaacaactgcttctacagttcagcaggaatttaagagatgattaaataaaagccccaccagtctcaaagttgccagt

SEQ ID NO: 355637 - DNA, 495 bp, Homo sapiens
gtctctggtgataagggctttttgccctagtatggggagggtacccctctcagaggaatctttatgacttgctacatgcaagaagagacaggtcagctagccttttctgaaactacaatttctccaatgctttcacctcaaaattaacaatatacctatcggacatattctgagatggcacatgactccttcaagggtatttcacacacatgctaggaagtgaggggttaagtgtccctgtgtgctttttcagatacgtggcttcagagagagcaagaaggctgaggaggatgaggagggcagggtgaggctctctccccaggctgatgatctcctttcccttgtcttagtacaagcaaatgctggtgaatgctttcacggagcaaattctgcctcacttctccacggagggcccccaacgtctgctgccggttctggacagaatctacccagtgaccgaaatccaggaggcccataagtacatggaggccaaca

SEQ ID NO: 355638 - DNA, 756 bp, Homo sapiens
caagaatcgtctacattttgacattttattgtaggaaaataattttataatgcaaaatctgtcaaatatcttaaaacttttttagataatttgtaatttgttgtagtcaaattacaaattatggagagcttcacattacaagaatgagcttgacatggcatctgccctccacaactcactgtttagtcatcagactaatgtataaacaactattattatcttaatatgactgtacagtggttctgtgggagcataggggaggggtgcttaatcttggaaattttacaggatttatttatttattgcctgaactaagatgtgaaggctcactaggactttgataaagaaactgcaaagtcatgatattatggtttgttttaggaattcatgatttgttcctgtagctgaaacatacattgaatggtaagttagagcccgacataaaagactttctgtactgtactagaaaattagtgtctgggtgtggtggctcactcctgtaatcccgtcactttgggaggccaaggtgggaggatcgcttaaggctgggagttcagccaggccacaaagaccccatctctatgggcatggtggtgcgggtgtagtggtgcgcactgctactactagctacttgggctgctgaggcagaacgatcattttgagctcacgagttgcagagactgcagtgaggtatgatagagctccactgaactccagcctgcaccacagagtgagaccctgtctctaaaaaaaaaa

SEQ ID NO: 355639 - DNA, 1852 bp, Homo sapiens
aaagaaagaatacatgtgaagaacttggaacagtgcctagaacatagtataggggttcaggtgttactaattataattatttataattgttatttttatttataattataattgttaacttttactgttaccattatttcctggctttacattggtttaagataatatctgtagggtatagtataatgttatccaaatattaaattacatatagtatgtttagttttatttagcattgttaagattactcagtgtcaaagggagcattttaaaattatttagtttttgagacggggtctcacactcacccaggttggagtatagtagcacaatctcagctcactgaagcctctgcctcctgggctcaagcagtcctcccacctcagcctcctgagtagcttgagaatacaggtgtgcacaccacactgcactgctttttaaattttttgtagatgtgaagtctcactgtattgaccaggctggtctcgaacttaggagatcaagcagtcttcctgcctcaccctccaaaggtgctgggattacaggcatgagctactgcacctggccagaggcaacattaaaaaaaaaaaaaaaagattgttgaggctttttaactcacaactcttggagacataaaacttctgttatctcaggcacttggtaaatctgaagcttcagagaaaagagggtcagggggtaggacatgatcaatttcagttatgttatagacttaatatgggaacaccttatatagtgcttgacattttatagaacattttttacttctgtttttagttaacatggatatttgtgtcagttcatcgataaggttctgaaatctagaaatataggtggtttctctcacttacacgattattatgtaatatacttgagcttaagaatccaagattctggatagcattgtttctttgggaaaatgtagattctaagttccgaacagttgatttcctaaatatctttcagttctcagccatttgtaagctgcgcttcacctgctactaatcttgctgttacttctgctatcccatctttaaatttttatcacaatttgaatgattggcaactatgatcatcttatgtctttagtaacagtaagcaaaatttacatgtttttaaaggaaaatttaatttctataaatattgttaaaaaggggttatttgtggatatgtaattttgttttggtgtatttttctgtaactttaaggaagcactaatctgtttagtgtttgttctgttttgccttgttgagaggttgattacttttaatatgaaataattttaaaaggaggctttttataaggttgtaggggctttttaaagttattgatacctttttttttttagtttgtagataactgctatagagatcagtaccattgcatattttgcatagtgtagaaccagtggtcattaatttttaaaactaccttatgcaagtgtagttttcaaggaaataaatacatagatgcatatacaattaaacaagaaaatgaaaacagtttaaaataggataaggaaatatacagatagaatactgagagtaataaatatggagagtgggtcagaattgtaacattgataggcattgcataaaccctgcagcatttttaagttaaacttgctctcattttgggtatcaagaaaattgcaggaaaacacaactagctctataatgagtattgcatataagaaaaagagactggacatggtggctcactcctttaatctcagcactttgggaggccaaggtgggagggtcacttgtggccaggagttcgagaccagtctgggtgacatagtgggacccctctctaaaaataaaatgaaaaa

SEQ ID NO: 355640 - DNA, 640 bp, Homo sapiens
actacatacttccgatagaaatgaatctcctatactgattctctctttagatccatttgctacatttaaactactgtatttctttctgcatgtttctagtttattaaccttgcaagaactcttcaggcacatatggaagatctcgaaagtaggtggaatttcccctccccagactagttgaatttacttttgcaaattaaacccaaagcaaaacctaagtatatactctgttctgccaaattagagctcatttataggcttagtaataccaaaatgattgatttgggaaatatgggtcgggaaactgacattagtttttttttttttttaaagcatattttaaggtatggaagcatgtaatcgtttacggagctgcattttacttttttttttcaaagagaaatttattgttgatcaccttgatttcaggatttataataaaaaaggcataaatcttaactactaatcaaaccaacatttcttaatctgttaggattttgttttgtttcgtttctggtaagaaattttacctgttactcaggtttgttagatcataagagattattcctgggcttacctatgattccaggaaaatatgggacaaggagtcctaattctgaatccatatcagaagccatga

SEQ ID NO: 355641 - DNA, 758 bp, Homo sapiens
caagaatcgtctacattttgacattttattgtaggaaaataattttataatgcaaaatctgtcaaatatcttaaaacttttttagataatttgtaatttgttgtagtcaaattacaaattatggagagcttcacattacaagaatgagcttgacatggcatctgccctccacaactcactgtttagtcatcagactaatgtataaacaactattattatcttaatatgactgtacagtggttctgtgggagcataggggaggggtgcttaatcttggaaattttacaggatttatttatttattgcctgaactaagatgtgaaggctcactaggactttgataaagaaactgcaaagtcatgatattatggtttgttttaggaattcatgatttgttcctgtagctgaaacatacattgaatggtaagttagagcccgacataaaagactttctgtactgtactagaaaattagtgtctgggtgtggtggctcactcctgtaatcccgtcactttgggaggccaaggtgggaggatcgcttaaggctgggagttcagccaggccacaaagaccccatctctatgggcatggtggtgcgggtgtagtggtgcgcactgctactactagctatcgggaggctgaggcaggagaatggcatgaaccctggaggcagagcttgcagtgaatcaagatcacgccactgcactctagcctgggcgacagagcgagactctgtctcaaaaaaaacaaaaaacaaa

SEQ ID NO: 355642 - DNA, 3517 bp, Homo sapiens
cgcgaagtggggggaggaggagcagggaggggcacttaacggtggtggctggttctgcgccggatccgggagaggggcgggcgccattgtgcttcgctgccgactgcatttcctcagtcacgggcctagaactccaaggagaaaggcggcgaaaaatctttaagaatggagtctaaaccttcaaggattccaagaagaatttctgttcaaccttccagctccttaagtgctaggatgatgtctggaagcagaggaagtagtttaaatgatacctatcactcaagagactcttcatttagattggattctgaatatcagtctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtactacctcagctgggagaaatgttggaaatggtttaaacacattatcagattcatcttggaggcatagtcaagttcctagatcttcatcaatggtacttggatcatttggaacagacttaatgagagagaggagagatttggagagaagaacagattcctctattagtaatcttatggattatagtcaccgaagtggtgatttcacaacttcatcatatgttcaagacagagttccttcatattcacaaggagcaagaccaaaagaaaactcaatgagcactttacagttgaatacatcatccacaaaccaccaattgccttctgaacatcagaccatactaagttctagggattccagaaattctttaagatcaaatttttcttcaagagaatcagaatcttcccgaagcaatacgcagcctggattttcttacagttcaagtagagatgaagccccaatcataagcaattcagaaagggttgtttcatctcaaagaccatttcaagaatcttctgacaatgaaggtaggcggacaacgaggagattgctgtcacgcatagcttctagcatgtcatctacttttttttcacgaagatctagtcaggattccttgaatacaagatcattgaattctgaaaattcttacgtttctccaagaatcttgacagcttcacagtcccgtagtaatgtaccatcagcttctgaagttcccgataatagggcatctgaagcttctcagggatttcgatttcttaggcgaagatggggtttgtcatctcttagccacaatcatagctctgagtcagattcagaaaattttaaccaagaatctgaaggtagaaatacaggaccatggttatcttcctcacttagaaatagatgcacacctttgttctctagaaggaggcgagagggaagagatgaatcttcaaggatacctacctctgatacatcatctagatctcatatttttagaagagaatcaaatgaagtggttcaccttgaagcacagaatgatcctcttggagctgctgccaacagaccacaagcatctgcagcatcaagcagtgccacaacaggtggctctacatcagattcggctcaaggtggaagaaatacaggaatatcagggattcttcctggttccttattccggtttgcagtccccccagcacttgggagtaatttgaccgacaatgtcatgatcacagtagatattattccttcaggttggaattcagctgatggtaaaagtgataaaactaaaagtgcgccttcaagagatccagaaagattgcagaaaataaaagagagcctccttttagaggactcagaagaagaagaaggtgacttatgtagaatttgtcaaatggcagctgcatcatcatctaatttgctgatagagccatgcaagtgcacaggaagtttgcagtatgtccaccaagactgtatgaaaaagtggttacaggccaaaattaactctggttcttcattagaagctgtaaccacctgtgaactatgtaaagagaagttggagcttaacctggaggattttgatattcatgaactacatagagctcatgcaaatgaacaagctgagtatgagtttatcagctctggtctctacctagtggtgttattgcacttgtgcgaacaaagcttttctgatatgatgggaaatacaaatgaaccaagcacacgtgtccgatttattaaccttgcaagaactcttcaggcacatatggaagatctcgaaacttcagaggatgattccgaagaagacggagaccataacaggacatttgatattgcctaacttcatataagacagatggatgatctgtgaacataagtgtttattaaaaatggcaattaaatataaattacttttgtgggggaatgcctaataaatacattgactatatataaaatgaatatatacatacacatgtatgcctgtatatatatattcattctccagtgttgctgaattaaaattctgctggactttttaacatagcaaatccgatgtttataaactggtaatcaaaaaggttttttcttttaggtgagtgggaaagtattacccttgttttaaatatctaagcaatgcctatcaacccttttttgtgttatgattactgtagtcatatttatgaaaaaaggtttgtgttttactcttgctagtgagaaaagtgggacaaaatatacttttgaaataaaatgctatatggcacctaattattttttcttttaaaatgccttaagttgcagtctcattttgataatcatttgcttccagtgtttaaaaattaaaaaaagaatggggagaaggttatgagaagagcattattaagtttccaaatttaatttgaattccaaattcacctagcaataaaatctaatttttaaaaagtatataaatataaaatgtataaatgatggatagatttttgtattgatttgcaaaatgcagattatatttgataggctatagtatgtagatattccttttaggaatattacagctgtaaattatatgagacttgccagtcaaatgctatttggtttaaaaaaattattgcaatctcaagttaatggaatatttttaaatcccacattcagagtttaaaacactggttttcaatgtgttttttagtgttgtcacttgtttatagataaatatataaataacctgtttggatcctggtcctttttaactgttccttggtaattctgagcatttatttgatgacttaatatttttcactacctttggagaacagatgaacattattcaccatgaatggatctatactgtgtggtcatgagttgtgtatacttccataacactgtatttttcttctgtcagtacccttaggatacactttaaaacaccttaaggtctgatgttatggcaacaaactactttttcaaacctaaataggaaccatgtaatttctcaaaagtgattgaacagtttgcccacacttagtttgttggtcttatgtaaaacattggctcaaaataaagtacacactgatttattttac

SEQ ID NO: 355643 - DNA, 4311 bp, Homo sapiens
aaagaaagaatacatgtgaagaacttggaacagtgcctagaacatagtataggggttcaggtgttactaattataattatttataattgttatttttatttataattataattgttaacttttactgttaccattatttcctggctttacattggtttaagataatatctgtagggtatagtataatgttatccaaatattaaattacatatagtatgtttagttttatttagcattgttaagattactcagtgtcaaagggagcattttaaaattatttagtttttgagacggggtctcacactcacccaggttggagtatagtagcacaatctcagctcactgaagcctctgcctcctgggctcaagcagtcctcccacctcagcctcctgagtagcttgagaatacaggtgtgcacaccacactgcactgctttttaaattttttgtagatgtgaagtctcactgtattgaccaggctggtctcgaacttaggagatcaagcagtcttcctgcctcaccctccaaaggtgctgggattacaggcatgagctactgcacctggccagaggcaacattaaaaaaaaaaaaaaaagattgttgaggctttttaactcacaactcttggagacataaaacttctgttatctcaggcacttggtaaatctgaagcttcagagaaaagagggtcagggggtaggacatgatcaatttcagttatgttatagacttaatatgggaacaccttatatagtgcttgacattttatagaacattttttacttctgtttttagttaacatggatatttgtgtcagttcatcgataaggttctgaaatctagaaatataggtggtttctctcacttacacgattattatgtaatatacttgagcttaagaatccaagattctggatagcattgtttctttgggaaaatgtagattctaagttccgaacagttgatttcctaaatatctttcagttctcagccatttgtaagctgcgcttcacctgctactaatcttgctgttacttctgctatcccatctttaaatttttatcacaatttgaatgattggcaactatgatcatcttatgtctttagtaacatctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtactacctcagctgggagaaatgttggaaatggtttaaacacattatcagattcatcttggaggcatagtcaagttcctagatcttcatcaatggtacttggatcatttggaacagacttaatgagagagaggagagatttggagagaagaacagattcctctattagtaatcttatggattatagtcaccgaagtggtgatttcacaacttcatcatatgttcaagacagagttccttcatattcacaaggagcaagaccaaaagaaaactcaatgagcactttacagttgaatacatcatccacaaaccaccaattgccttctgaacatcagaccatactaagttctagggattccagaaattctttaagatcaaatttttcttcaagagaatcagaatcttcccgaagcaatacgcagcctggattttcttacagttcaagtagagatgaagccccaatcataagcaattcagaaagggttgtttcatctcaaagaccatttcaagaatcttctgacaatgaaggtaggcggacaacgaggagattgctgtcacgcatagcttctagcatgtcatctacttttttttcacgaagatctagtcaggattccttgaatacaagatcattgaattctgaaaattcttacgtttctccaagaatcttgacagcttcacagtcccgtagtaatgtaccatcagcttctgaagttcccgataatagggcatctgaagcttctcagggatttcgatttcttaggcgaagatggggtttgtcatctcttagccacaatcatagctctgagtcagattcagaaaattttaaccaagaatctgaaggtagaaatacaggaccatggttatcttcctcacttagaaatagatgcacacctttgttctctagaaggaggcgagagggaagagatgaatcttcaaggatacctacctctgatacatcatctagatctcatatttttagaagagaatcaaatgaagtggttcaccttgaagcacagaatgatcctcttggagctgctgccaacagaccacaagcatctgcagcatcaagcagtgccacaacaggtggctctacatcagattcggctcaaggtggaagaaatacaggaatatcagggattcttcctggttccttattccggtttgcagtccccccagcacttgggagtaatttgaccgacaatgtcatgatcacagtagatattattccttcaggttggaattcagctgatggtaaaagtgataaaactaaaagtgcgccttcaagagatccagaaagattgcagaaaataaaagagagcctccttttagaggactcagaagaagaagaaggtgacttatgtagaatttgtcaaatggcagctgcatcatcatctaatttgctgatagagccatgcaagtgcacaggaagtttgcagtatgtccaccaagactgtatgaaaaagtggttacaggccaaaattaactctggttcttcattagaagctgtaaccacctgtgaactatgtaaagagaagttggagcttaacctggaggattttgatattcatgaactacatagagctcatgcaaatgaacaagctgagtatgagtttatcagctctggtctctacctagtggtgttattgcacttgtgcgaacaaagcttttctgatatgatgggaaatacaaatgaaccaagcacacgtgtccgatttattaaccttgcaagaactcttcaggcacatatggaagatctcgaaacttcagaggatgattccgaagaagacggagaccataacaggacatttgatattgcctaacttcatataagacagatggatgatctgtgaacataagtgtttattaaaaatggcaattaaatataaattacttttgtgggggaatgcctaataaatacattgactatatataaaatgaatatatacatacacatgtatgcctgtatatatatattcattctccagtgttgctgaattaaaattctgctggactttttaacatagcaaatccgatgtttataaactggtaatcaaaaaggttttttcttttaggtgagtgggaaagtattacccttgttttaaatatctaagcaatgcctatcaacccttttttgtgttatgattactgtagtcatatttatgaaaaaaggtttgtgttttactcttgctagtgagaaaagtgggacaaaatatacttttgaaataaaatgctatatggcacctaattattttttcttttaaaatgccttaagttgcagtctcattttgataatcatttgcttccagtgtttaaaaattaaaaaaagaatggggagaaggttatgagaagagcattattaagtttccaaatttaatttgaattccaaattcacctagcaataaaatctaatttttaaaaagtatataaatataaaatgtataaatgatggatagatttttgtattgatttgcaaaatgcagattatatttgataggctatagtatgtagatattccttttaggaatattacagctgtaaattatatgagacttgccagtcaaatgctatttggtttaaaaaaattattgcaatctcaagttaatggaatatttttaaatcccacattcagagtttaaaacactggttttcaatgtgttttttagtgttgtcacttgtttatagataaatatataaataacctgtttggatcctggtcctttttaactgttccttggtaattctgagcatttatttgatgacttaatatttttcactacctttggagaacagatgaacattattcaccatgaatggatctatactgtgtggtcatgagttgtgtatacttccataacactgtatttttcttctgtcagtacccttaggatacactttaaaacaccttaaggtctgatgttatggcaacaaactactttttcaaacctaaataggaaccatgtaatttctcaaaagtgattgaacagtttgcccacacttagtttgttggtcttatgtaaaacattggctcaaaataaagtacacactgatttattttac

SEQ ID NO: 355644 - DNA, 3700 bp, Homo sapiens
cgcgaagtggggggaggaggagcagggaggggcacttaacggtggtggctggttctgcgccggatccgggagaggggcgggcgccattgtgcttcgctgccgactgcatttcctcagtcacgggcctagaactccaaggagaaaggcggcggtgcgtgttgctgcgagtgggacgcgcactggtcggtgccggctcaggagccggggaattcatgatttgttcctgtagctgaaacatacattgaatgctttctgccctggcatgaacttacatggtcagagctggtttttcctgccctcaaatatatttctctgactctaccggttagactagaaaaatctttaagaatggagtctaaaccttcaaggattccaagaagaatttctgttcaaccttccagctccttaagtgctaggatgatgtctggaagcagaggaagtagtttaaatgatacctatcactcaagagactcttcatttagattggattctgaatatcagtctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtactacctcagctgggagaaatgttggaaatggtttaaacacattatcagattcatcttggaggcatagtcaagttcctagatcttcatcaatggtacttggatcatttggaacagacttaatgagagagaggagagatttggagagaagaacagattcctctattagtaatcttatggattatagtcaccgaagtggtgatttcacaacttcatcatatgttcaagacagagttccttcatattcacaaggagcaagaccaaaagaaaactcaatgagcactttacagttgaatacatcatccacaaaccaccaattgccttctgaacatcagaccatactaagttctagggattccagaaattctttaagatcaaatttttcttcaagagaatcagaatcttcccgaagcaatacgcagcctggattttcttacagttcaagtagagatgaagccccaatcataagcaattcagaaagggttgtttcatctcaaagaccatttcaagaatcttctgacaatgaaggtaggcggacaacgaggagattgctgtcacgcatagcttctagcatgtcatctacttttttttcacgaagatctagtcaggattccttgaatacaagatcattgaattctgaaaattcttacgtttctccaagaatcttgacagcttcacagtcccgtagtaatgtaccatcagcttctgaagttcccgataatagggcatctgaagcttctcagggatttcgatttcttaggcgaagatggggtttgtcatctcttagccacaatcatagctctgagtcagattcagaaaattttaaccaagaatctgaaggtagaaatacaggaccatggttatcttcctcacttagaaatagatgcacacctttgttctctagaaggaggcgagagggaagagatgaatcttcaaggatacctacctctgatacatcatctagatctcatatttttagaagagaatcaaatgaagtggttcaccttgaagcacagaatgatcctcttggagctgctgccaacagaccacaagcatctgcagcatcaagcagtgccacaacaggtggctctacatcagattcggctcaaggtggaagaaatacaggaatatcagggattcttcctggttccttattccggtttgcagtccccccagcacttgggagtaatttgaccgacaatgtcatgatcacagtagatattattccttcaggttggaattcagctgatggtaaaagtgataaaactaaaagtgcgccttcaagagatccagaaagattgcagaaaataaaagagagcctccttttagaggactcagaagaagaagaaggtgacttatgtagaatttgtcaaatggcagctgcatcatcatctaatttgctgatagagccatgcaagtgcacaggaagtttgcagtatgtccaccaagactgtatgaaaaagtggttacaggccaaaattaactctggttcttcattagaagctgtaaccacctgtgaactatgtaaagagaagttggagcttaacctggaggattttgatattcatgaactacatagagctcatgcaaatgaacaagctgagtatgagtttatcagctctggtctctacctagtggtgttattgcacttgtgcgaacaaagcttttctgatatgatgggaaatacaaatgaaccaagcacacgtgtccgatttattaaccttgcaagaactcttcaggcacatatggaagatctcgaaacttcagaggatgattccgaagaagacggagaccataacaggacatttgatattgcctaacttcatataagacagatggatgatctgtgaacataagtgtttattaaaaatggcaattaaatataaattacttttgtgggggaatgcctaataaatacattgactatatataaaatgaatatatacatacacatgtatgcctgtatatatatattcattctccagtgttgctgaattaaaattctgctggactttttaacatagcaaatccgatgtttataaactggtaatcaaaaaggttttttcttttaggtgagtgggaaagtattacccttgttttaaatatctaagcaatgcctatcaacccttttttgtgttatgattactgtagtcatatttatgaaaaaaggtttgtgttttactcttgctagtgagaaaagtgggacaaaatatacttttgaaataaaatgctatatggcacctaattattttttcttttaaaatgccttaagttgcagtctcattttgataatcatttgcttccagtgtttaaaaattaaaaaaagaatggggagaaggttatgagaagagcattattaagtttccaaatttaatttgaattccaaattcacctagcaataaaatctaatttttaaaaagtatataaatataaaatgtataaatgatggatagatttttgtattgatttgcaaaatgcagattatatttgataggctatagtatgtagatattccttttaggaatattacagctgtaaattatatgagacttgccagtcaaatgctatttggtttaaaaaaattattgcaatctcaagttaatggaatatttttaaatcccacattcagagtttaaaacactggttttcaatgtgttttttagtgttgtcacttgtttatagataaatatataaataacctgtttggatcctggtcctttttaactgttccttggtaattctgagcatttatttgatgacttaatatttttcactacctttggagaacagatgaacattattcaccatgaatggatctatactgtgtggtcatgagttgtgtatacttccataacactgtatttttcttctgtcagtacccttaggatacactttaaaacaccttaaggtctgatgttatggcaacaaactactttttcaaacctaaataggaaccatgtaatttctcaaaagtgattgaacagtttgcccacacttagtttgttggtcttatgtaaaacattggctcaaaataaagtacacactgatttattttac

SEQ ID NO: 355645 - DNA, 4262 bp, Homo sapiens
aaagaaagaatacatgtgaagaacttggaacagtgcctagaacatagtataggggttcaggtgttactaattataattatttataattgttatttttatttataattataattgttaacttttactgttaccattatttcctggctttacattggtttaagataatatctgtagggtatagtataatgttatccaaatattaaattacatatagtatgtttagttttatttagcattgttaagattactcagtgtcaaagggagcattttaaaattatttagtttttgagacggggtctcacactcacccaggttggagtatagtagcacaatctcagctcactgaagcctctgcctcctgggctcaagcagtcctcccacctcagcctcctgagtagcttgagaatacaggtgtgcacaccacactgcactgctttttaaattttttgtagatgtgaagtctcactgtattgaccaggctggtctcgaacttaggagatcaagcagtcttcctgcctcaccctccaaaggtgctgggattacaggcatgagctactgcacctggccagaggcaacattaaaaaaaaaaaaaaaagattgttgaggctttttaactcacaactcttggagacataaaacttctgttatctcaggcacttggtaaatctgaagcttcagagaaaagagggtcagggggtaggacatgatcaatttcagttatgttatagacttaatatgggaacaccttatatagtgcttgacattttatagaacattttttacttctgtttttagttaacatggatatttgtgtcagttcatcgataaggttctgaaatctagaaatataggtggtttctctcacttacacgattattatgtaatatacttgagcttaagaatccaagattctggatagcattgtttctttgggaaaatgtagattctaagttccgaacagttgatttcctaaatatctttcagttctcagccatttgtaagctgcgcttcacctgctactaatcttgctgttacttctgctatcccatctttaaatttttatcacaatttgaatgattggcaactatgatcatcttatgtctttagtaacatctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtactacctcagctgggagaaatgttggaaatggtttaaacacattatcagattcatcttggaggcatagtcaagttcctagatcttcatcaatggtacttggatcatttggaacagacttaatgagagagaggagagatttggagagaagaacagattcctctattagtaatcttatggattatagtcaccgaagtggtgatttcacaacttcatcatatgttcaagacagagttccttcatattcacaaggagcaagaccaaaagaaaactcaatgagcactttacagttgaatacatcatccacaaaccaccaattgccttctgaacatcagaccatactaagttctagggattccagaaattctttaagatcaaatttttcttcaagagaatcagaatcttcccgaagcaatacgcagcctggattttcttacagttcaagtagagatgaagccccaatcataagcaattcagaaagggttgtttcatctcaaagaccatttcaagaatcttctgacaatgaaggtaggcggacaacgaggagattgctgtcacgcatagcttctagcatgtcatctacttttttttcacgaagatctagtcaggattccttgaatacaagatcattgaattctgaaaattcttacgtttctccaagaatcttgacagcttcacagtcccgtagtaatgtaccatcagcttctgaagttcccgataatagggcatctgaagcttctcagggatttcgatttcttaggcgaagatggggtttgtcatctcttagccacaatcatagctctgagtcagattcagaaaattttaaccaagaatctgaaggtagaaatacaggaccatggttatcttcctcacttagaaatagatgcacacctttgttctctagaaggaggcgagagggaagagatgaatcttcaaggatacctacctctgatacatcatctagatctcatatttttagaagagaatcaaatgaagtggttcaccttgaagcacagaatgatcctcttggagctgctgccaacagaccacaagcatctgcagcatcaagcagtgccacaacaggtggctctacatcagattcggctcaaggtggaagaaatacaggaatatcagggattcttcctggttccttattccggtttgcagtccccccagcacttgggagtaatttgaccgacaatgtcatgatcacagtagatattattccttcaggttggaattcagctgatggtaaaagtgataaaactaaaagtgcgccttcaagagatccagaaagattgcagaaaataaaagagagcctccttttagaggactcagaagaagaagaaggtgacttatgtagaatttgtcaaatggcagctgcatcatcatctaatttgctgatagagccatgcaagtgcacaggaagtttgcagtatgtccaccaagactgtatgaaaaagtggttacaggccaaaattaactctggttcttcattagaagctgtaaccacctgtgaactatgtaaagagaagttggagcttaacctggaggattttgatattcatgaactacatagagctcatgcaaatgaacaagctgagtatgagtttatcagctctggtctctacctagtggtgttattgcacttgtgcgaacaaagcttttctgatatgatgggaaatacaaatgaaccaagcacacgtgtccgacttcagaggatgattccgaagaagacggagaccataacaggacatttgatattgcctaacttcatataagacagatggatgatctgtgaacataagtgtttattaaaaatggcaattaaatataaattacttttgtgggggaatgcctaataaatacattgactatatataaaatgaatatatacatacacatgtatgcctgtatatatatattcattctccagtgttgctgaattaaaattctgctggactttttaacatagcaaatccgatgtttataaactggtaatcaaaaaggttttttcttttaggtgagtgggaaagtattacccttgttttaaatatctaagcaatgcctatcaacccttttttgtgttatgattactgtagtcatatttatgaaaaaaggtttgtgttttactcttgctagtgagaaaagtgggacaaaatatacttttgaaataaaatgctatatggcacctaattattttttcttttaaaatgccttaagttgcagtctcattttgataatcatttgcttccagtgtttaaaaattaaaaaaagaatggggagaaggttatgagaagagcattattaagtttccaaatttaatttgaattccaaattcacctagcaataaaatctaatttttaaaaagtatataaatataaaatgtataaatgatggatagatttttgtattgatttgcaaaatgcagattatatttgataggctatagtatgtagatattccttttaggaatattacagctgtaaattatatgagacttgccagtcaaatgctatttggtttaaaaaaattattgcaatctcaagttaatggaatatttttaaatcccacattcagagtttaaaacactggttttcaatgtgttttttagtgttgtcacttgtttatagataaatatataaataacctgtttggatcctggtcctttttaactgttccttggtaattctgagcatttatttgatgacttaatatttttcactacctttggagaacagatgaacattattcaccatgaatggatctatactgtgtggtcatgagttgtgtatacttccataacactgtatttttcttctgtcagtacccttaggatacactttaaaacaccttaaggtctgatgttatggcaacaaactactttttcaaacctaaataggaaccatgtaatttctcaaaagtgattgaacagtttgcccacacttagtttgttggtcttatgtaaaacattggctcaaaataaagtacacactgatttattttac

SEQ ID NO: 355646 - DNA, 4340 bp, Homo sapiens
aaagaaagaatacatgtgaagaacttggaacagtgcctagaacatagtataggggttcaggtgttactaattataattatttataattgttatttttatttataattataattgttaacttttactgttaccattatttcctggctttacattggtttaagataatatctgtagggtatagtataatgttatccaaatattaaattacatatagtatgtttagttttatttagcattgttaagattactcagtgtcaaagggagcattttaaaattatttagtttttgagacggggtctcacactcacccaggttggagtatagtagcacaatctcagctcactgaagcctctgcctcctgggctcaagcagtcctcccacctcagcctcctgagtagcttgagaatacaggtgtgcacaccacactgcactgctttttaaattttttgtagatgtgaagtctcactgtattgaccaggctggtctcgaacttaggagatcaagcagtcttcctgcctcaccctccaaaggtgctgggattacaggcatgagctactgcacctggccagaggcaacattaaaaaaaaaaaaaaaagattgttgaggctttttaactcacaactcttggagacataaaacttctgttatctcaggcacttggtaaatctgaagcttcagagaaaagagggtcagggggtaggacatgatcaatttcagttatgttatagacttaatatgggaacaccttatatagtgcttgacattttatagaacattttttacttctgtttttagttaacatggatatttgtgtcagttcatcgataaggttctgaaatctagaaatataggtggtttctctcacttacacgattattatgtaatatacttgagcttaagaatccaagattctggatagcattgtttctttgggaaaatgtagattctaagttccgaacagttgatttcctaaatatctttcagttctcagccatttgtaagctgcgcttcacctgctactaatcttgctgttacttctgctatcccatctttaaatttttatcacaatttgaatgattggcaactatgatcatcttatgtctttagtaacatctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtactacctcagctgggagaaatgttggaaatggtttaaacacattatcagattcatcttggaggcatagtcaagttcctagatcttcatcaatggtacttggatcatttggaacagacttaatgagagagaggagagatttggagagaagaacagattcctctattagtaatcttatggattatagtcaccgaagtggtgatttcacaacttcatcatatgttcaagacagagttccttcatattcacaaggagcaagaccaaaagaaaactcaatgagcactttacagttgaatacatcatccacaaaccaccaattgccttctgaacatcagaccatactaagttctagggattccagaaattctttaagatcaaatttttcttcaagagaatcagaatcttcccgaagcaatacgcagcctggattttcttacagttcaagtagagatgaagccccaatcataagcaattcagaaagggttgtttcatctcaaagaccatttcaagaatcttctgacaatgaaggtaggcggacaacgaggagattgctgtcacgcatagcttctagcatgtcatctacttttttttcacgaagatctagtcaggattccttgaatacaagatcattgaattctgaaaattcttacgtttctccaagaatcttgacagcttcacagtcccgtagtaatgtaccatcagcttctgaagttcccgataatagggcatctgaagcttctcagggatttcgatttcttaggcgaagatggggtttgtcatctcttagccacaatcatagctctgagtcagattcagaaaattttaaccaagaatctgaaggtagaaatacaggaccatggttatcttcctcacttagaaatagatgcacacctttgttctctagaaggaggcgagagggaagagatgaatcttcaaggatacctacctctgatacatcatctagatctcatatttttagaagagaatcaaatgaagtggttcaccttgaagcacagaatgatcctcttggagctgctgccaacagaccacaagcatctgcagcatcaagcagtgccacaacaggtggctctacatcagattcggctcaaggtggaagaaatacaggaatatcagggattcttcctggttccttattccggtttgcagtccccccagcacttgggagtaatttgaccgacaatgtcatgatcacagtagatattattccttcaggttggaattcagctgatggtaaaagtgataaaactaaaagtgctgcccttccaagcagaatcccaggaaaagcattggcaggcaaccatcaccaagagaagcctccgtatttcagccagggattccagcaagcacagcacagcacaggttgcacttcatgtccagacaatttggtcaaaatgggcaagcttgaattcaatcaatactaagatttgcttgataagaagccattggcaatgttgcaccatgggaaagttttggccagtaattggttccaccaatgactggtatgacaaaacgtggtttacatgggccaaaaaattacactactgggttcttcattagaagctgtaaccacctgtgaactatgtaaagagaagttggagcttaacctggaggattttgatattcatgaactacatagagctcatgcaaatgaacaagctgagtatgagtttatcagctctggtctctacctagtggtgttattgcacttgtgcgaacaaagcttttctgatatgatgggaaatacaaatgaaccaagcacacgtgtccgacttcagaggatgattccgaagaagacggagaccataacaggacatttgatattgcctaacttcatataagacagatggatgatctgtgaacataagtgtttattaaaaatggcaattaaatataaattacttttgtgggggaatgcctaataaatacattgactatatataaaatgaatatatacatacacatgtatgcctgtatatatatattcattctccagtgttgctgaattaaaattctgctggactttttaacatagcaaatccgatgtttataaactggtaatcaaaaaggttttttcttttaggtgagtgggaaagtattacccttgttttaaatatctaagcaatgcctatcaacccttttttgtgttatgattactgtagtcatatttatgaaaaaaggtttgtgttttactcttgctagtgagaaaagtgggacaaaatatacttttgaaataaaatgctatatggcacctaattattttttcttttaaaatgccttaagttgcagtctcattttgataatcatttgcttccagtgtttaaaaattaaaaaaagaatggggagaaggttatgagaagagcattattaagtttccaaatttaatttgaattccaaattcacctagcaataaaatctaatttttaaaaagtatataaatataaaatgtataaatgatggatagatttttgtattgatttgcaaaatgcagattatatttgataggctatagtatgtagatattccttttaggaatattacagctgtaaattatatgagacttgccagtcaaatgctatttggtttaaaaaaattattgcaatctcaagttaatggaatatttttaaatcccacattcagagtttaaaacactggttttcaatgtgttttttagtgttgtcacttgtttatagataaatatataaataacctgtttggatcctggtcctttttaactgttccttggtaattctgagcatttatttgatgacttaatatttttcactacctttggagaacagatgaacattattcaccatgaatggatctatactgtgtggtcatgagttgtgtatacttccataacactgtatttttcttctgtcagtacccttaggatacactttaaaacaccttaaggtctgatgttatggcaacaaactactttttcaaacctaaataggaaccatgtaatttctcaaaagtgattgaacagtttgcccacacttagtttgttggtcttatgtaaaacattggctcaaaataaagtacacactgatttattttac

SEQ ID NO: 355647 - DNA, 3212 bp, Homo sapiens
aaagaaagaatacatgtgaagaacttggaacagtgcctagaacatagtataggggttcaggtgttactaattataattatttataattgttatttttatttataattataattgttaacttttactgttaccattatttcctggctttacattggtttaagataatatctgtagggtatagtataatgttatccaaatattaaattacatatagtatgtttagttttatttagcattgttaagattactcagtgtcaaagggagcattttaaaattatttagtttttgagacggggtctcacactcacccaggttggagtatagtagcacaatctcagctcactgaagcctctgcctcctgggctcaagcagtcctcccacctcagcctcctgagtagcttgagaatacaggtgtgcacaccacactgcactgctttttaaattttttgtagatgtgaagtctcactgtattgaccaggctggtctcgaacttaggagatcaagcagtcttcctgcctcaccctccaaaggtgctgggattacaggcatgagctactgcacctggccagaggcaacattaaaaaaaaaaaaaaaagattgttgaggctttttaactcacaactcttggagacataaaacttctgttatctcaggcacttggtaaatctgaagcttcagagaaaagagggtcagggggtaggacatgatcaatttcagttatgttatagacttaatatgggaacaccttatatagtgcttgacattttatagaacattttttacttctgtttttagttaacatggatatttgtgtcagttcatcgataaggttctgaaatctagaaatataggtggtttctctcacttacacgattattatgtaatatacttgagcttaagaatccaagattctggatagcattgtttctttgggaaaatgtagattctaagttccgaacagttgatttcctaaatatctttcagttctcagccatttgtaagctgcgcttcacctgctactaatcttgctgttacttctgctatcccatctttaaatttttatcacaatttgaatgattggcaactatgatcatcttatgtctttagtaacatctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtactacctcagctgggagaaatgttggaaatggtttaaacacattatcagattcatcttggaggcatagtcaagttcctagatcttcatcaatggtacttggatcatttggaacagacttaatgagagagaggagagatttggagagaagaacagattcctctattagtaatcttatggattatagtcaccgaagtggtgatttcacaacttcatcatcctccttttagaggactcagaagaagaagaaggtgacttatgtagaatttgtcaaatggcagctgcatcatcatctaatttgctgatagagccatgcaagtgcacaggaagtttgcagtatgtccaccaagactgtatgaaaaagtggttacaggccaaaattaactctggttcttcattagaagctgtaaccacctgtgaactatgtaaagagaagttggagcttaacctggaggattttgatattcatgaactacatagagctcatgcaaatgaacaagctgagtatgagtttatcagctctggtctctacctagtggtgttattgcacttgtgcgaacaaagcttttctgatatgatgggaaatacaaatgaaccaagcacacgtgtccgatttattaaccttgcaagaactcttcaggcacatatggaagatctcgaaacttcagaggatgattccgaagaagacggagaccataacaggacatttgatattgcctaacttcatataagacagatggatgatctgtgaacataagtgtttattaaaaatggcaattaaatataaattacttttgtgggggaatgcctaataaatacattgactatatataaaatgaatatatacatacacatgtatgcctgtatatatatattcattctccagtgttgctgaattaaaattctgctggactttttaacatagcaaatccgatgtttataaactggtaatcaaaaaggttttttcttttaggtgagtgggaaagtattacccttgttttaaatatctaagcaatgcctatcaacccttttttgtgttatgattactgtagtcatatttatgaaaaaaggtttgtgttttactcttgctagtgagaaaagtgggacaaaatatacttttgaaataaaatgctatatggcacctaattattttttcttttaaaatgccttaagttgcagtctcattttgataatcatttgcttccagtgtttaaaaattaaaaaaagaatggggagaaggttatgagaagagcattattaagtttccaaatttaatttgaattccaaattcacctagcaataaaatctaatttttaaaaagtatataaatataaaatgtataaatgatggatagatttttgtattgatttgcaaaatgcagattatatttgataggctatagtatgtagatattccttttaggaatattacagctgtaaattatatgagacttgccagtcaaatgctatttggtttaaaaaaattattgcaatctcaagttaatggaatatttttaaatcccacattcagagtttaaaacactggttttcaatgtgttttttagtgttgtcacttgtttatagataaatatataaataacctgtttggatcctggtcctttttaactgttccttggtaattctgagcatttatttgatgacttaatatttttcactacctttggagaacagatgaacattattcaccatgaatggatctatactgtgtggtcatgagttgtgtatacttccataacactgtatttttcttctgtcagtacccttaggatacactttaaaacaccttaaggtctgatgttatggcaacaaactactttttcaaacctaaataggaaccatgtaatttctcaaaagtgattgaacagtttgcccacacttagtttgttggtcttatgtaaaacattggctcaaaataaagtacacactgatttattttac

SEQ ID NO: 355648 - DNA, 4364 bp, Homo sapiens
aaagaaagaatacatgtgaagaacttggaacagtgcctagaacatagtataggggttcaggtgttactaattataattatttataattgttatttttatttataattataattgttaacttttactgttaccattatttcctggctttacattggtttaagataatatctgtagggtatagtataatgttatccaaatattaaattacatatagtatgtttagttttatttagcattgttaagattactcagtgtcaaagggagcattttaaaattatttagtttttgagacggggtctcacactcacccaggttggagtatagtagcacaatctcagctcactgaagcctctgcctcctgggctcaagcagtcctcccacctcagcctcctgagtagcttgagaatacaggtgtgcacaccacactgcactgctttttaaattttttgtagatgtgaagtctcactgtattgaccaggctggtctcgaacttaggagatcaagcagtcttcctgcctcaccctccaaaggtgctgggattacaggcatgagctactgcacctggccagaggcaacattaaaaaaaaaaaaaaaagattgttgaggctttttaactcacaactcttggagacataaaacttctgttatctcaggcacttggtaaatctgaagcttcagagaaaagagggtcagggggtaggacatgatcaatttcagttatgttatagacttaatatgggaacaccttatatagtgcttgacattttatagaacattttttacttctgtttttagttaacatggatatttgtgtcagttcatcgataaggttctgaaatctagaaatataggtggtttctctcacttacacgattattatgtaatatacttgagcttaagaatccaagattctggatagcattgtttctttgggaaaatgtagattctaagttccgaacagttgatttcctaaatatctttcagttctcagccatttgtaagctgcgcttcacctgctactaatcttgctgttacttctgctatcccatctttaaatttttatcacaatttgaatgattggcaactatgatcatcttatgtctttagtaacatctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtactacctcagctgggagaaatgttggaaatggtttaaacacattatcagattcatcttggaggcatagtcaagttcctagatcttcatcaatggtacttggatcatttggaacagacttaatgagagagaggagagatttggagagaagaacagattcctctattagtaatcttatggattatagtcaccgaagtggtgatttcacaacttcatcatatgttcaagacagagttccttcatattcacaaggagcaagaccaaaagaaaactcaatgagcactttacagttgaatacatcatccacaaaccaccaattgccttctgaacatcagaccatactaagttctagggattccagaaattctttaagatcaaatttttcttcaagagaatcagaatcttcccgaagcaatacgcagcctggattttcttacagttcaagtagagatgaagccccaatcataagcaattcagaaagggttgtttcatctcaaagaccatttcaagaatcttctgacaatgaaggtaggcggacaacgaggagattgctgtcacgcatagcttctagcatgtcatctacttttttttcacgaagatctagtcaggattccttgaatacaagatcattgaattctgaaaattcttacgtttctccaagaatcttgacagcttcacagtcccgtagtaatgtaccatcagcttctgaagttcccgataatagggcatctgaagcttctcagggatttcgatttcttaggcgaagatggggtttgtcatctcttagccacaatcatagctctgagtcagattcagaaaattttaaccaagaatctgaaggtagaaatacaggaccatggttatcttcctcacttagaaatagatgcacacctttgttctctagaaggaggcgagagggaagagatgaatcttcaaggatacctacctctgatacatcatctagatctcatatttttagaagagaatcaaatgaagtggttcaccttgaagcacagaatgatcctcttggagctgctgccaacagaccacaagcatctgcagcatcaagcagtgccacaacaggtggctctacatcagattcggctcaaggtggaagaaatacaggaatatcagggattcttcctggttccttattccggtttgcagtccccccagcacttgggagtaatttgaccgacaatgtcatgatcacagtagatattattccttcaggttggaattcagctgatggtaaaagtgataaaactaaaagtgcgccttcaagagatccagaaagattgcagaaaataaaagagagcctccttttagaggactcagaagaagaagaaggtgacttatgtagaatttgtcaaatggcagctgcatcatcatctaatttgctgatagagccatgcaagtgcacaggaagtttgcagtatgtccaccaagactgtatgaaaaagtggttacaggccaaaattaactctggttcttcattagaagctgtaaccacctgtgaactatgtaaagagaagttggagcttaacctggaggattttgatattcatgaactacatagagctcatgcaaatgaacaagctgagtatgagtttatcagctctggtctctacctagtggtgttattgcacttgtgcgaacaaagcttttctgatatgatgggaaatacaaatgaaccaagcacacgtgtccgatttattaaccttgcaagaactcttcaggcacatatggaagatctcgaaacttcagaggatgattccgaagaagacggagaccataacaggacatttgatattgcctaacttcatataagacagatggatgatctgtgaacataagtgtttattaaaaatggcaattaaatataaattacttttgtgggggaatgcctaataaatacattgactatatataaaatgaatatatacatacacatgtatgcctgtatatatatattcattctccagtgttgctgaattaaaattctgctggactttttaacatagcaaatccgatgtttataaactggtaatcaaaaaggttttttcttttaggtgagtgggaaagtattacccttgttttaaatatctaagcaatgcctatcaacccttttttgtgttatgattactgtagtcatatttatgaaaaaaggtttgtgttttactcttgctagtgagaaaagtgggacaaaatatacttttgaaataaaatgctatatggcacctaattattttttcttttaaaatgccttaagttgcagtctcaatttttaaacactggaagcaaatgattatcaaaatgagactgcaacttaaggattttgataatcatttgcttccagtgtttaaaaattaaaaaaagaatggggagaaggttatgagaagagcattattaagtttccaaatttaatttgaattccaaattcacctagcaataaaatctaatttttaaaaagtatataaatataaaatgtataaatgatggatagatttttgtattgatttgcaaaatgcagattatatttgataggctatagtatgtagatattccttttaggaatattacagctgtaaattatatgagacttgccagtcaaatgctatttggtttaaaaaaattattgcaatctcaagttaatggaatatttttaaatcccacattcagagtttaaaacactggttttcaatgtgttttttagtgttgtcacttgtttatagataaatatataaataacctgtttggatcctggtcctttttaactgttccttggtaattctgagcatttatttgatgacttaatatttttcactacctttggagaacagatgaacattattcaccatgaatggatctatactgtgtggtcatgagttgtgtatacttccataacactgtatttttcttctgtcagtacccttaggatacactttaaaacaccttaaggtctgatgttatggcaacaaactactttttcaaacctaaataggaaccatgtaatttctcaaaagtgattgaacagtttgcccacacttagtttgttggtcttatgtaaaacattggctcaaaataaagtacacactgatttattttac

SEQ ID NO: 355649 - DNA, 2489 bp, Homo sapiens
tccatactcaaataagcatgaaagacaagggtgctgcaagttaacccctaaatatcagagtattagtacattctgaaatgggttctgactaaattatcctctcctgtggagtggagttaaatggaaaaacacaagaagttccttaataagctgtaattttttagtttggtatttctcagtgatagagcataaaacttaacagtagagtttattatcagtcatgacttagttatatgctttgtcatttattaaatggatttaaatctattagtgttgcatagtttttctgtgctttgccctaggttgattccatttgttggatgctcttaatttgtccaatgtaaatataaaaagagagggcattaaaccgttttgccctataatgggggaaagatgctggttagatgtttattttagtgagcttgcattttcttacacgtgcaaagcagttcatagaattcatagttttacacttactatgtctttcctaaagacacccaggatgctttatttttaactcttgagccactagtgactcttgaataaattgaggtcagaaatgttgcaaaagtggtaagtttctggcagtgtggagacaggggaataatctcaacagtaggtttttactgaatccaattattttaatttaggctgtgtctatatgaagcttttttgacttactaaatgaacttttatcttggcattgtatagacatagctttgatgtaaattgcaagaacacccataacctcttattctatgtacatttcttttcattctcatcggatgcaccaaacatgcagcggtaataagccagattttactcaggtgtgtgagagcacttgccttaagttgacttttttcctagtgtttatatatcattagctactatgaacacagattgatctcagaaacattttagaagatgctcttgaaccacatttttaagcactttcatttttataaaaattgatataacattacaaaacgatgtgggggcggggagaattgtggttgggtatcacccacaggcagaccaccctaaccctgtcatacaacttatcattttgatcaaacaatatactaaattgggatttttgtttttacaagtcattgctgttctggcttcatatttacacttcccattcttatcccccttaaaatcattcttgatcatcctgttttctttcaacacttcagaggatgattccgaagaagacggagaccataacaggacatttgatattgcctaacttcatataagacagatggatgatctgtgaacataagtgtttattaaaaatggcaattaaatataaattacttttgtgggggaatgcctaataaatacattgactatatataaaatgaatatatacatacacatgtatgcctgtatatatatattcattctccagtgttgctgaattaaaattctgctggactttttaacatagcaaatccgatgtttataaactggtaatcaaaaaggttttttcttttaggtgagtgggaaagtattacccttgttttaaatatctaagcaatgcctatcaacccttttttgtgttatgattactgtagtcatatttatgaaaaaaggtttgtgttttactcttgctagtgagaaaagtgggacaaaatatacttttgaaataaaatgctatatggcacctaattattttttcttttaaaatgccttaagttgcagtctcattttgataatcatttgcttccagtgtttaaaaattaaaaaaagaatggggagaaggttatgagaagagcattattaagtttccaaatttaatttgaattccaaattcacctagcaataaaatctaatttttaaaaagtatataaatataaaatgtataaatgatggatagatttttgtattgatttgcaaaatgcagattatatttgataggctatagtatgtagatattccttttaggaatattacagctgtaaattatatgagacttgccagtcaaatgctatttggtttaaaaaaattattgcaatctcaagttaatggaatatttttaaatcccacattcagagtttaaaacactggttttcaatgtgttttttagtgttgtcacttgtttatagataaatatataaataacctgtttggatcctggtcctttttaactgttccttggtaattctgagcatttatttgatgacttaatatttttcactacctttggagaacagatgaacattattcaccatgaatggatctatactgtgtggtcatgagttgtgtatacttccataacactgtatttttcttctgtcagtacccttaggatacactttaaaacaccttaaggtctgatgttatggcaacaaactactttttcaaacctaaataggaaccatgtaatttctcaaaagtgattgaacagtttgcccacacttagtttgttggtcttatgtaaaacattggctcaaaataaagtacacactgatttattttac

SEQ ID NO: 355650 - DNA, 2435 bp, Homo sapiens
tccatactcaaataagcatgaaagacaagggtgctgcaagttaacccctaaatatcagagtattagtacattctgaaatgggttctgactaaattatcctctcctgtggagtggagttaaatggaaaaacacaagaagttccttaataagctgtaattttttagtttggtatttctcagtgatagagcataaaacttaacagtagagtttattatcagtcatgacttagttatatgctttgtcatttattaaatggatttaaatctattagtgttgcatagtttttctgtgctttgccctaggttgattccatttgttggatgctcttaatttgtccaatgtaaatataaaaagagagggcattaaaccgttttgccctataatgggggaaagatgctggttagatgtttattttagtgagcttgcattttcttacacgtgcaaagcagttcatagaattcatagttttacacttactatgtctttcctaaagacacccaggatgctttatttttaactcttgagccactagtgactcttgaataaattgaggtcagaaatgttgcaaaagtggtaagtttctggcagtgtggagacaggggaataatctcaacagtaggtttttactgaatccaattattttaatttaggctgtgtctatatgaagcttttttgacttactaaatgaacttttatcttggcattgtatagacatagctttgatgtaaattgcaagaacacccataacctcttattctatgtacatttcttttcattctcatcggatgcaccaaacatgcagcggtaataagccagattttactcaggtgtgtgagagcacttgccttaagttgacttttttcctagtgtttatatatcattagctactatgaacacagattgatctcagaaacattttagaagatgctcttgaaccacatttttaagcactttcatttttataaaaattgatataacattacaccctaaccctgtcatacaacttatcattttgatcaaacaatatactaaattgggatttttgtttttacaagtcattgctgttctggcttcatatttacacttcccattcttatcccccttaaaatcattcttgatcatcctgttttctttcaacacttcagaggatgattccgaagaagacggagaccataacaggacatttgatattgcctaacttcatataagacagatggatgatctgtgaacataagtgtttattaaaaatggcaattaaatataaattacttttgtgggggaatgcctaataaatacattgactatatataaaatgaatatatacatacacatgtatgcctgtatatatatattcattctccagtgttgctgaattaaaattctgctggactttttaacatagcaaatccgatgtttataaactggtaatcaaaaaggttttttcttttaggtgagtgggaaagtattacccttgttttaaatatctaagcaatgcctatcaacccttttttgtgttatgattactgtagtcatatttatgaaaaaaggtttgtgttttactcttgctagtgagaaaagtgggacaaaatatacttttgaaataaaatgctatatggcacctaattattttttcttttaaaatgccttaagttgcagtctcattttgataatcatttgcttccagtgtttaaaaattaaaaaaagaatggggagaaggttatgagaagagcattattaagtttccaaatttaatttgaattccaaattcacctagcaataaaatctaatttttaaaaagtatataaatataaaatgtataaatgatggatagatttttgtattgatttgcaaaatgcagattatatttgataggctatagtatgtagatattccttttaggaatattacagctgtaaattatatgagacttgccagtcaaatgctatttggtttaaaaaaattattgcaatctcaagttaatggaatatttttaaatcccacattcagagtttaaaacactggttttcaatgtgttttttagtgttgtcacttgtttatagataaatatataaataacctgtttggatcctggtcctttttaactgttccttggtaattctgagcatttatttgatgacttaatatttttcactacctttggagaacagatgaacattattcaccatgaatggatctatactgtgtggtcatgagttgtgtatacttccataacactgtatttttcttctgtcagtacccttaggatacactttaaaacaccttaaggtctgatgttatggcaacaaactactttttcaaacctaaataggaaccatgtaatttctcaaaagtgattgaacagtttgcccacacttagtttgttggtcttatgtaaaacattggctcaaaataaagtacacactgatttattttac

SEQ ID NO: 355651 - DNA, 3722 bp, Homo sapiens
aaagaaagaatacatgtgaagaacttggaacagtgcctagaacatagtataggggttcaggtgttactaattataattatttataattgttatttttatttataattataattgttaacttttactgttaccattatttcctggctttacattggtttaagataatatctgtagggtatagtataatgttatccaaatattaaattacatatagtatgtttagttttatttagcattgttaagattactcagtgtcaaagggagcattttaaaattatttagtttttgagacggggtctcacactcacccaggttggagtatagtagcacaatctcagctcactgaagcctctgcctcctgggctcaagcagtcctcccacctcagcctcctgagtagcttgagaatacaggtgtgcacaccacactgcactgctttttaaattttttgtagatgtgaagtctcactgtattgaccaggctggtctcgaacttaggagatcaagcagtcttcctgcctcaccctccaaaggtgctgggattacaggcatgagctactgcacctggccagaggcaacattaaaaaaaaaaaaaaaagattgttgaggctttttaactcacaactcttggagacataaaacttctgttatctcaggcacttggtaaatctgaagcttcagagaaaagagggtcagggggtaggacatgatcaatttcagttatgttatagacttaatatgggaacaccttatatagtgcttgacattttatagaacattttttacttctgtttttagttaacatggatatttgtgtcagttcatcgataaggttctgaaatctagaaatataggtggtttctctcacttacacgattattatgtaatatacttgagcttaagaatccaagattctggatagcattgtttctttgggaaaatgtagattctaagttccgaacagttgatttcctaaatatctttcagttctcagccatttgtaagctgcgcttcacctgctactaatcttgctgttacttctgctatcccatctttaaatttttatcacaatttgaatgattggcaactatgatcatcttatgtctttagtaacatctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtactacctcagctgggagaaatgttggaaatggtttaaacacattatcagattcatcttggaggcatagtcaagttcctagatcttcatcaatggtacttggatcatttggaacagacttaatgagagagaggagagatttggagagaagaacagattcctctattagtaatcttatggattatagtcaccgaagtggtgatttcacaacttcatcatatgttcaagacagagttccttcatattcacaaggagcaagaccaaaagaaaactcaatgagcactttacagttgaatacatcatccacaaaccaccaattgccttctgaacatcagaccatactaagttctagggattccagaaattctttaagatcaaatttttcttcaagagaatcagaatcttcccgaagcaatacgcagcctggattttcttacagttcaagtagagatgaagccccaatcataagcaattcagaaagggttgtttcatctcaaagaccatttcaagaatcttctgacaatgaaggtaggcggacaacgaggagattgctgtcacgcatagcttctagcatgtcatctacttttttttcacgaagatctagtcaggattccttgaatacaagatcattgaattctgaaaattcttacgtttctccaagaatcttgacagcttcacagtcccgtagtaatgtaccatcagcttctgaagttcccgataatagggcatctgaagcttctcagggatttcgatttcttaggcgaagatggggtttgtcatctcttagccacaatcatagctctgagtcagattcagaaaattttaaccaagaatctgaaggtagaaatacaggaccatggttatcttcctcacttagaaatagatgcacacctttgttctctagaaggaggcgagagggaagagatgaatcttcaaggatacctacctctgatacatcatctagatctcatatttttagaagagaatcaaatgaagtggttcaccttgaagcacagaatgatcctcttggagctgctgccaacagaccacaagcatctgcagcatcaagcagtgccacaacaggtggctctacatcagattcggctcaaggtggaagaaatacaggaatatcagggattcttcctggttccttattccggtttgcagtccccccagcacttgggagtaatttgaccgacaatgtcatgatcacagtagatattattccttcaggttggaattcagctgatggtaaaagtgataaaactaaaagtgcgccttcaagagatccagaaagattgcagaaaataaaagagagcctccttttagaggactcagaagaagaagaaggtgacttatgtagaatttgtcaaatggcagctgcatcatcatctaatttgctgatagagccatgcaagtgcacaggaagtttgcagtatgtccaccaagactgtatgaaaaagtggttacaggccaaaattaactctggttcttcattagaagctgtaaccacctgtgaactatgtaaagagaagttggagcttaacctggaggattttgatattcatgaactacatagagctcatgcaaatgaacaagctgagtatgagtttatcagctctggtctctacctagtggtgttattgcacttgtgcgaacaaagcttttctgatatgatgggaaatacaaatgaaccaagcacacgtgtccgatttattaaccttgcaagaactcttcaggcacatatggaagatctcgaaacttcagaggatgattccgaagaagacggagaccataacaggacatttgatattgcctaacttcatataagacagatggatgatctgtgaacataagtgtttattaaaaatggcaattaaatataaattacttttgtgggggaatgcctaataaatacattgactatatataaaatgaatatatacatacacatgtatgcctgtatatatatattcattctccagtgttgctgaattaaaattctgctggactttttaacatagcaaatccgatgtttataaactggtaatcaaaaaggttttttcttttaggtgagtgggaaagtattacccttgttttaaatatctaagcaatgcctatcaacccttttttgtgttatgattactgtagtcatatttatgaaaaaaggtttgtgttttactcttgctagtgagaaaagtgggacaaaatatacttttgaaataaaatgctatatggcacctaattattttttcttttaaaatgccttaagttgcagtctcgcgcattgagagtgcacacggcattgagtgtgcacacgaaacttatacaaagctgcaacccccagggatagcacgaatgctacagccatatgatttcgcagacgcctggccagaaggccacgcatccgaggttttggcaaaacttcggagcctatggtagttactgtccttatacgtgtgcactac

SEQ ID NO: 355652 - DNA, 3507 bp, Homo sapiens
aaagaaagaatacatgtgaagaacttggaacagtgcctagaacatagtataggggttcaggtgttactaattataattatttataattgttatttttatttataattataattgttaacttttactgttaccattatttcctggctttacattggtttaagataatatctgtagggtatagtataatgttatccaaatattaaattacatatagtatgtttagttttatttagcattgttaagattactcagtgtcaaagggagcattttaaaattatttagtttttgagacggggtctcacactcacccaggttggagtatagtagcacaatctcagctcactgaagcctctgcctcctgggctcaagcagtcctcccacctcagcctcctgagtagcttgagaatacaggtgtgcacaccacactgcactgctttttaaattttttgtagatgtgaagtctcactgtattgaccaggctggtctcgaacttaggagatcaagcagtcttcctgcctcaccctccaaaggtgctgggattacaggcatgagctactgcacctggccagaggcaacattaaaaaaaaaaaaaaaagattgttgaggctttttaactcacaactcttggagacataaaacttctgttatctcaggcacttggtaaatctgaagcttcagagaaaagagggtcagggggtaggacatgatcaatttcagttatgttatagacttaatatgggaacaccttatatagtgcttgacattttatagaacattttttacttctgtttttagttaacatggatatttgtgtcagttcatcgataaggttctgaaatctagaaatataggtggtttctctcacttacacgattattatgtaatatacttgagcttaagaatccaagattctggatagcattgtttctttgggaaaatgtagattctaagttccgaacagttgatttcctaaatatctttcagttctcagccatttgtaagctgcgcttcacctgctactaatcttgctgttacttctgctatcccatctttaaatttttatcacaatttgaatgattggcaactatgatcatcttatgtctttagtaacatctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtactacctcagctgggagaaatgttggaaatggtttaaacacattatcagattcatcttggaggcatagtcaagttcctagatcttcatcaatggtacttggatcatttggaacagacttaatgagagagaggagagatttggagagaagaacagattcctctattagtaatcttatggattatagtcaccgaagtggtgatttcacaacttcatcatatgttcaagacagagttccttcatattcacaaggagcaagaccaaaagaaaactcaatgagcactttacagttgaatacatcatccacaaaccaccaattgccttctgaacatcagaccatactaagttctagggattccagaaattctttaagatcaaatttttcttcaagagaatcagaatcttcccgaagcaatacgcagcctggattttcttacagttcaagtagagatgaagccccaatcataagcaattcagaaagggttgtttcatctcaaagaccatttcaagaatcttctgacaatgaaggtaggcggacaacgaggagattgctgtcacgcatagcttctagcatgtcatctacttttttttcacgaagatctagtcaggattccttgaatacaagatcattgaattctgaaaattcttacgtttctccaagaatcttgacagcttcacagtcccgtagtaatgtaccatcagcttctgaagttcccgataatagggcatctgaagcttctcagggatttcgatttcttaggcgaagatggggtttgtcatctcttagccacaatcatagctctgagtcagattcagaaaattttaaccaagaatctgaaggtagaaatacaggaccatggttatcttcctcacttagaaatagatgcacacctttgttctctagaaggaggcgagagggaagagatgaatcttcaaggatacctacctctgatacatcatctagatctcatatttttagaagagaatcaaatgaagtggttcaccttgaagcacagaatgatcctcttggagctgctgccaacagaccacaagcatctgcagcatcaagcagtgccacaacaggtggctctacatcagattcggctcaaggtggaagaaatacaggaatatcagggattcttcctggttccttattccggtttgcagtccccccagcacttgggagtaatttgaccgacaatgtcatgatcacagtagatattattccttcaggttggaattcagctgatggtaaaagtgataaaactaaaagtgcgccttcaagagatccagaaagattgcagaaaataaaagagagcctccttttagaggactcagaagaagaagaaggtgacttatgtagaatttgtcaaatggcagctgcatcatcatctaatttgctgatagagccatgcaagtgcacaggaagtttgcagtatgtccaccaagactgtatgaaaaagtggttacaggccaaaattaactctggttcttcattagaagctgtaaccacctgtgaactatgtaaagagaagttggagcttaacctggaggattttgatattcatgaactacatagagctcatgcaaatgaacaagctgagtatgagtttatcagctctggtctctacctagtggtgttattgcacttgtgcgaacaaagcttttctgatatgatgggaaatacaaatgaaccaagcacacgtgtccgatttattaaccttgcaagaactcttcaggcacatatggaagatctcgaaagtaggtggaatttcccctccccagactagttgaatttacttttgcaaattaaacccaaagcaaaacctaagtatatactctgttctgccaaattagagctcatttataggcttagtaataccaaaatgattgatttgggaaatatgggtcgggaaactgacattagtttttttttttttttaaagcatattttaaggtatggaagcatgtaatcgtttacggagctgcattttacttttttttttcaaagagaaatttattgttgatcaccttgatttcaggatttataataaaaaaggcataaatcttaactactaatcaaaccaacatttcttaatctgttaggattttgttttgtttcgtttctggtaagaaattttacctgttactcaggtttgttagatcataagagattattcctgggcttacctatgattccaggaaaatatgggacaaggagtcctaattctgaatccatatcagaagccatga

SEQ ID NO: 355653 - DNA, 3372 bp, Homo sapiens
aaagaaagaatacatgtgaagaacttggaacagtgcctagaacatagtataggggttcaggtgttactaattataattatttataattgttatttttatttataattataattgttaacttttactgttaccattatttcctggctttacattggtttaagataatatctgtagggtatagtataatgttatccaaatattaaattacatatagtatgtttagttttatttagcattgttaagattactcagtgtcaaagggagcattttaaaattatttagtttttgagacggggtctcacactcacccaggttggagtatagtagcacaatctcagctcactgaagcctctgcctcctgggctcaagcagtcctcccacctcagcctcctgagtagcttgagaatacaggtgtgcacaccacactgcactgctttttaaattttttgtagatgtgaagtctcactgtattgaccaggctggtctcgaacttaggagatcaagcagtcttcctgcctcaccctccaaaggtgctgggattacaggcatgagctactgcacctggccagaggcaacattaaaaaaaaaaaaaaaagattgttgaggctttttaactcacaactcttggagacataaaacttctgttatctcaggcacttggtaaatctgaagcttcagagaaaagagggtcagggggtaggacatgatcaatttcagttatgttatagacttaatatgggaacaccttatatagtgcttgacattttatagaacattttttacttctgtttttagttaacatggatatttgtgtcagttcatcgataaggttctgaaatctagaaatataggtggtttctctcacttacacgattattatgtaatatacttgagcttaagaatccaagattctggatagcattgtttctttgggaaaatgtagattctaagttccgaacagttgatttcctaaatatctttcagttctcagccatttgtaagctgcgcttcacctgctactaatcttgctgttacttctgctatcccatctttaaatttttatcacaatttgaatgattggcaactatgatcatcttatgtctttagtaacatctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtactacctcagctgggagaaatgttggaaatggtttaaacacattatcagattcatcttggaggcatagtcaagttcctagatcttcatcaatggtacttggatcatttggaacagacttaatgagagagaggagagatttggagagaagaacagattcctctattagtaatcttatggattatagtcaccgaagtggtgatttcacaacttcatcatatgttcaagacagagttccttcatattcacaaggagcaagaccaaaagaaaactcaatgagcactttacagttgaatacatcatccacaaaccaccaattgccttctgaacatcagaccatactaagttctagggattccagaaattctttaagatcaaatttttcttcaagagaatcagaatcttcccgaagcaatacgcagcctggattttcttacagttcaagtagagatgaagccccaatcataagcaattcagaaagggttgtttcatctcaaagaccatttcaagaatcttctgacaatgaaggtaggcggacaacgaggagattgctgtcacgcatagcttctagcatgtcatctacttttttttcacgaagatctagtcaggattccttgaatacaagatcattgaattctgaaaattcttacgtttctccaagaatcttgacagcttcacagtcccgtagtaatgtaccatcagcttctgaagttcccgataatagggcatctgaagcttctcagggatttcgatttcttaggcgaagatggggtttgtcatctcttagccacaatcatagctctgagtcagattcagaaaattttaaccaagaatctgaaggtagaaatacaggaccatggttatcttcctcacttagaaatagatgcacacctttgttctctagaaggaggcgagagggaagagatgaatcttcaaggatacctacctctgatacatcatctagatctcatatttttagaagagaatcaaatgaagtggttcaccttgaagcacagaatgatcctcttggagctgctgccaacagaccacaagcatctgcagcatcaagcagtgccacaacaggtggctctacatcagattcggctcaaggtggaagaaatacaggaatatcagggattcttcctggttccttattccggtttgcagtccccccagcacttgggagtaatttgaccgacaatgtcatgatcacagtagatattattccttcaggttggaattcagctgatggtaaaagtgataaaactaaaagtgcgccttcaagagatccagaaagattgcagaaaataaaagagagcctccttttagaggactcagaagaagaagaaggtgacttatgtagaatttgtcaaatggcagctgcatcatcatctaatttgctgatagagccatgcaagtgcacaggaagtttgcagtatgtccaccaagactgtatgaaaaagtggttacaggccaaaattaactctggttcttcattagaagctgtaaccacctgtgaactatgtaaagagaagttggagcttaacctggaggattttgatattcatgaactacatagagctcatgcaaatgaacaagctgagtatgagtttatcagctctggtctctacctagtggtgttattgcacttgtgcgaacaaagcttttctgatatgatgggaaatacaaatgaaccaagcacacgtgtccgagtaagtaataatgaagttggggagagggagggtatgatgcagcaagtgtatgccttggaaagcagattgtttcatatgttgacatcttatttcctttgggaagcttttattttttaaatgtttcttaaaaataaagataccgtagatttaatggaaattgctgtcttctataacaagcagcctgattttctcataaagttattttagagaaagaagtaattttctagctctcaaaggtaattggaatgtatttcattgaaaaacagaattggaaacatcgagggaaaatgggctttttattattaaaacaaaacctcagtattatcacttagaaacctgaaattgaactccaaaagccaaagagtatgggaaattaacttcaatttatttgttactgttctacaaa

SEQ ID NO: 355654 - DNA, 3572 bp, Homo sapiens
cgcgaagtggggggaggaggagcagggaggggcacttaacggtggtggctggttctgcgccggatccgggagaggggcgggcgccattgtgcttcgctgccgactgcatttcctcagtcacgggcctagaactccaaggagaaaggcggcggtgcgtgttgctgcgagtgggacgcgcactggtcggtgccggctcaggagccgggaaaaatctttaagaatggagtctaaaccttcaaggattccaagaagaatttctgttcaaccttccagctccttaagtgctaggatgatgtctggaagcagaggaagtagtttaaatgatacctatcactcaagagactcttcatttagattggattctgaatatcagtctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtactacctcagctgggagaaatgttggaaatggtttaaacacattatcagattcatcttggaggcatagtcaagttcctagatcttcatcaatggtacttggatcatttggaacagacttaatgagagagaggagagatttggagagaagaacagattcctctattagtaatcttatggattatagtcaccgaagtggtgatttcacaacttcatcatatgttcaagacagagttccttcatattcacaaggagcaagaccaaaagaaaactcaatgagcactttacagttgaatacatcatccacaaaccaccaattgccttctgaacatcagaccatactaagttctagggattccagaaattctttaagatcaaatttttcttcaagagaatcagaatcttcccgaagcaatacgcagcctggattttcttacagttcaagtagagatgaagccccaatcataagcaattcagaaagggttgtttcatctcaaagaccatttcaagaatcttctgacaatgaaggtaggcggacaacgaggagattgctgtcacgcatagcttctagcatgtcatctacttttttttcacgaagatctagtcaggattccttgaatacaagatcattgaattctgaaaattcttacgtttctccaagaatcttgacagcttcacagtcccgtagtaatgtaccatcagcttctgaagttcccgataatagggcatctgaagcttctcagggatttcgatttcttaggcgaagatggggtttgtcatctcttagccacaatcatagctctgagtcagattcagaaaattttaaccaagaatctgaaggtagaaatacaggaccatggttatcttcctcacttagaaatagatgcacacctttgttctctagaaggaggcgagagggaagagatgaatcttcaaggatacctacctctgatacatcatctagatctcatatttttagaagagaatcaaatgaagtggttcaccttgaagcacagaatgatcctcttggagctgctgccaacagaccacaagcatctgcagcatcaagcagtgccacaacaggtggctctacatcagattcggctcaaggtggaagaaatacaggaatatcagggattcttcctggttccttattccggtttgcagtccccccagcacttgggagtaatttgaccgacaatgtcatgatcacagtagatattattccttcaggttggaattcagctgatggtaaaagtgataaaactaaaagtgcgccttcaagagatccagaaagattgcagaaaataaaagagagcctccttttagaggactcagaagaagaagaaggtgacttatgtagaatttgtcaaatggcagctgcatcatcatctaatttgctgatagagccatgcaagtgcacaggaagtttgcagtatgtccaccaagactgtatgaaaaagtggttacaggccaaaattaactctggttcttcattagaagctgtaaccacctgtgaactatgtaaagagaagttggagcttaacctggaggattttgatattcatgaactacatagagctcatgcaaatgaacaagctgagtatgagtttatcagctctggtctctacctagtggtgttattgcacttgtgcgaacaaagcttttctgatatgatgggaaatacaaatgaaccaagcacacgtgtccgatttattaaccttgcaagaactcttcaggcacatatggaagatctcgaaacttcagaggatgattccgaagaagacggagaccataacaggacatttgatattgcctaacttcatataagacagatggatgatctgtgaacataagtgtttattaaaaatggcaattaaatataaattacttttgtgggggaatgcctaataaatacattgactatatataaaatgaatatatacatacacatgtatgcctgtatatatatattcattctccagtgttgctgaattaaaattctgctggactttttaacatagcaaatccgatgtttataaactggtaatcaaaaaggttttttcttttaggtgagtgggaaagtattacccttgttttaaatatctaagcaatgcctatcaacccttttttgtgttatgattactgtagtcatatttatgaaaaaaggtttgtgttttactcttgctagtgagaaaagtgggacaaaatatacttttgaaataaaatgctatatggcacctaattattttttcttttaaaatgccttaagttgcagtctcattttgataatcatttgcttccagtgtttaaaaattaaaaaaagaatggggagaaggttatgagaagagcattattaagtttccaaatttaatttgaattccaaattcacctagcaataaaatctaatttttaaaaagtatataaatataaaatgtataaatgatggatagatttttgtattgatttgcaaaatgcagattatatttgataggctatagtatgtagatattccttttaggaatattacagctgtaaattatatgagacttgccagtcaaatgctatttggtttaaaaaaattattgcaatctcaagttaatggaatatttttaaatcccacattcagagtttaaaacactggttttcaatgtgttttttagtgttgtcacttgtttatagataaatatataaataacctgtttggatcctggtcctttttaactgttccttggtaattctgagcatttatttgatgacttaatatttttcactacctttggagaacagatgaacattattcaccatgaatggatctatactgtgtggtcatgagttgtgtatacttccataacactgtatttttcttctgtcagtacccttaggatacactttaaaacaccttaaggtctgatgttatggcaacaaactactttttcaaacctaaataggaaccatgtaatttctcaaaagtgattgaacagtttgcccacacttagtttgttggtcttatgtaaaacattggctcaaaataaagtacacactgatttattttac

SEQ ID NO: 355655 - DNA, 2860 bp, Homo sapiens
gcttctctgatttgcttgggtaacctttattttctaagataaaggaggaaatgatacgatcccagtcttcattcttggtatcaagcaaaaccaggatcaggtcaaatcgacttaagagtgggctgccgagggcaatgttcacagacacggactcctgggggtcgtactggcctttggggttcgttgctgccaggatggtggtccttgtgttcagcttgcacacgaggtttgttctccgcctttgtcctaatccacaccagcaggtggagccgcagttaaagtttccgagtccattccgggagcgggagcccatcttgctggctgccgaggccctcgctggaggaggagggtcagaactcgggtgcagccaatcgagggcaacgctgctacttatcagagcagaatgggctgtagtttagtgaaataggaaagctgcaaaacactgtggagtgctcccgtgtaaataaaaagaggaaaaaagtttctcaagtcgccgctgcacgacgtctggccggcgctggagcgggggtctgcgctctcccgagcggccgcgcgctggactttattgtgccgcaaccagccccagttcccattgtttgtgtttttttcaaaatatggcaaaggttcaggtgaacaatgtagtggtgctggataacccttctcctttctacaacccgttccagttcgagatcaccttcgagtgcatcgaggacctgtctgaagacttggaatggaaaattatctatgtgggctctgcagaaagtgaagaatacgatcaagttttagactctgttttagtgggtcctgttcccgcaggaaggcatatgtttgtatttcaggctgatgcacctaatccaggactcattccagatgcagatgcagtaggcgtaactgttgtgctaattacttgtacctatcgaggacaagaatttattagagttggctattatgtaaataatgaatatactgagacagaattaagggaaaatccaccagtaaaaccagacttttctaagcttcaaaggaatattttggcatctaatcccagggtcacaagattccacattaattgggaagataacacagaaaaactggaagatgcagagagcagtaatccaaatctacagtcacttctttcaacagatgcattaccttcagcatcaaagggatggtccacatcagaaaactcactaaatgtcatgttagaatcccacatggactgcatgtgaccacctaccatccctttagtacaaattaagctattaaaaatacacagaactatttccctgaaattccgtaagtacatagtcaaaacacaatgtgaagaatttgtttaaaaacatcctgtagaaagtttataagaaaaccagtatttgaacaaattgtggaatataaatacaactatttttaagtaatttttttctctaatgtgttattttatttgttctgaaactaatctgattaaagcatatatattattttcttctcctttatatgtaatgaaagcacttataaagaaacaggaatcattagaccaggttgtaaagatgtcttggcctcccagacagtctttggaccactattttactggcctttgaaagaacaaagtttacttcaactaaaatgtttcttcctgtgaagacatatggtatcattttaatttaaggggcagatttccattcttttttggcatgtccttaaaaagaggatttgaaatcaactatatgctaccaagaactttaggatccaattttccaagccaccgtgaagcctcttatggctactattatagttcatgagatgttggacagcatttggtttgtttggtaagagaagaacaaatatggctaattgttaataaggtcccctggctatggtttttgttcttataacagagtttagaatatcagagcatttcttgaatcatacatcattattgtccagtgaattcaagaccaaatacaatatcgggagaaaatacaaactccctgtgtttaagaataggggattataatggctcaaattggttcatttgatttctaaaaataccatgacctttaaaaattcttttaatagatcatgttattggcagtatttatataaaaaccatggatttagaaaggtatatttagctttattataatagatacgttactattttggaaatatatatattttcacacctgtagtactcttccccatttcctctgacactcatgcagaatgagatcaggcatatttgtggttgacatactctagatagcttttccaacaaatctttgaaaagcaatcttggaaaggaattcattaactaaatggggtaaaaggtttctttttctttgagagttaagtccttcctcaaaaaattttcttatgctccataaaattgaggtagaatattttcattattcttgcagctaagcaagacagccatatgatgcaggttatgcagtgccttcatatctaaaacttttatactgcactttttaaagcttttatgttgaggaaaggaaaagggcatttgtctaaacatggattctgagttgtatatatttcctatcattctaaaaaagtgaatttgtgaagcaaagttttgccagatgttaaactttgaatttaatataccagattattaaaatattgtccattaactagttcatagattttaaaagtaaaatacttctgactgttaaaactatataaagaaaatctcatttgtctaattgcaattaaaagaaaaatgttaaaatattaaaatgaaaataaaagcattactttccaacaaagagctcagtggttaatataataggaacaacatatgtgcttattagaaataaagcatatacagccaaatcaccaa

SEQ ID NO: 355656 - DNA, 2781 bp, Homo sapiens
gcttctctgatttgcttgggtaacctttattttctaagataaaggaggaaatgatacgatcccagtcttcattcttggtatcaagcaaaaccaggatcaggtcaaatcgacttaagagtgggctgccgagggcaatgttcacagacacggactcctgggggtcgtactggcctttggggttcgttgctgccaggatggtggtccttgtgttcagcttgcacacgaggtttgttctccgcctttgtcctaatccacaccagcaggtggagccgcagttaaagtttccgagtccattccgggagcgggagcccatcttgctggctgccgaggccctcgctggaggaggagggtcagaactcgggtgcagccaatcgagggcaacgctgctacttatcagagcagaatgggctgtagtttagtgaaataggaaagctgcaaaacactgtggagtgctcccgtgtaaataaaaagaggaaaaaagtttctcaagtcgccgctgcacgacgtctggccggcgctggagcgggggtctgcgctctcccgagcggccgcgcgctggactttattgtgccgcaaccagccccagttcccattgtttgtgtttttttcaaaatatggcaaaggttcaggtgaacaatgtagtggtgctggataacccttctcctttctacaacccgttccagttcgagatcaccttcgagtgcatcgaggacctgtctgaagacttggaatggaaaattatctatgtgggctctgcagaaagtgaagaatacgatcaagttttagactctgttttagtgggtcctgttcccgcaggaaggcatatgtttgtatttcaggctgatgcacctaatccaggactcattccagatgcagatgcagtaggcgtaactgttgtgctaattacttgtacctatcgaggacaagaatttattagagttggctattatgtaaataatgaatatactgagacagaattaagggaaaatccaccagtaaaaccagacttttctaagcttcaaaggaatattttggcatctaatcccagggtcacaagattccacattaattgggaagataacacagaaaaactggaagatgcagagagcagtaatccaaatctacagtcacttctttcaacagatgcattaccttcagcatcaaagggatggtccacatcagaaaactcactaaatgtcatgttagaatcccacatggactgcatgtgaccacctaccatccctttagtacaaattaagctattaaaaatacacagaactatttccctgaaattccgtaagtacatagtcaaaacacaatgtgaagaatttgtttaaaaacatcctgtagaaagtttataagaaaaccagtatttgaacaaattgtggaatataaatacaactatttttaagtaatttttttctctaatgtgttattttatttgttctgaaactaatctgattaaagcatatatattattttcttctcctttatatgtaatgaaagcacttataaagaaacaggaatcattagaccaggttgtaaagatgtcttggcctcccagacagtctttggaccactattttactggcctttgaaagaacaaagtttacttcaactaaaatgtttcttcctgtgaagacatatggtatcattttaatttaaggggcagatttccattcttttttggcatgtccttaaaaagaggatttgaaatcaactatatgctaccaagaactttaggatccaattttccaagccaccgtgaagcctcttatggctactattatagttcatgagatgttggacagcatttggtttgtttggtaagagaagaacaaatatggctaattgttaataaggtcccctggctatggtttttgttcttataacagagtttagaatatcagagcatttcttgaatcatacatcattattgtccagtgaattcaagaccaaatacaatatcgggagaaaatacaaactccctgtgtttaagaataggggattataatggctcaaattggttcatttgatttctaaaaataccatgacctttaaaaattcttttaatagatcatgttattggcagtatttatataaaaaccatggatttagaaaggtatatttagctttattataatagatacgttactattttggaaatatatatattttcacacctgtagtactcttccccatttcctctgacactcatgcagaatgagatcaggcatatttgtggttgacatactctagatagcttttccaacaaatctttgaaaagcaatcttggaaaggaattcattaactaaatggggtaaaaggtttctttttctttgagagttaagtccttcctcaaaaaattttcttatgctccataaaattgaggtagaatattttcattattcttgcagctaagcaagacagccatatgatgcaggttatgcagtgccttcatatctaaaacttttatactgcactttttaaagcttttatgttgaggaaaggaaaagggcatttgtctaaacatggattctgagttgtatatatttcctatcattctaaaaaagtgaatttgtgaagcaaagttttgccagatgttaaactttgaatttaatataccagattattaaaatattgtccattaactagttcatagattttaaaagtaaaatacttctgactgttaaaactatataaagaaaatctcatttgtctaattgcaattaaaagaaaaatgttaaaatattaaaatgaaaataaaagcattactttcca

SEQ ID NO: 355657 - DNA, 824 bp, Homo sapiens
aaggtgtaggaaaccattaataataagttgtatttgacaatttttcattttcctttgaaaacataccaatctaaacaacatagtagcttgttaaataaagcatcttctgaagcattcattttcaaaaatgaggagattctttcttttagaaaacagaagtataggagttaaatagttaaaaagccagatgaatcccctcagattctccgtatcttgtttctgttaatctaaaataacttctttgctacagccctagtcgttacatcttattagttatatttaaggtacttaacttgaattatacctttgtatatgaacttagccctttaggagtactaacatgaaccattttattaagcttctatttgtatatggtgatttaactttcttagtgtttaccatttgtatgtttcctttttcctctagcttcaaaggaatattttggcatctaatcccagggtcacaagattccacattaattgggaagataacacagaaaaactggaagatgcagagagcagtaatccaaatctacagtcacttctttcaacagatgcattaccttcagcatcaaagggatggtccacatcagaaaactcactaaatgtcatgttagaatcccacatggactgcatgtgaccacctaccatccctttagtacaaattaagctattaaaaatacacagaactatttccctgaaattccgtaagtacatagtcaaaacacaatgtgaagaatttgtttaaaaacatcctgtagaaagtttataagaaaaccagtatttgaacaaattgtggaatataaatacaactatttttaagta

SEQ ID NO: 355658 - DNA, 2270 bp, Homo sapiens
aaggtgtaggaaaccattaataataagttgtatttgacaatttttcattttcctttgaaaacataccaatctaaacaacatagtagcttgttaaataaagcatcttctgaagcattcattttcaaaaatgaggagattctttcttttagaaaacagaagtataggagttaaatagttaaaaagccagatgaatcccctcagattctccgtatcttgtttctgttaatctaaaataacttctttgctacagccctagtcgttacatcttattagttatatttaaggtacttaacttgaattatacctttgtatatgaacttagccctttaggagtactaacatgaaccattttattaagcttctatttgtatatggtgatttaactttcttagtgtttaccatttgtatgtttcctttttcctctagcttcaaaggaatattttggcatctaatcccagggtcacaagattccacattaattgggaagataacacagaaaaactggaagatgcagagagcagtaatccaaatctacagtcacttctttcaacagatgcattaccttcagcatcaaagggatggtccacatcagaaaactcactaaatgtcatgttagaatcccacatggactgcatgtgaccacctaccatccctttagtacaaattaagctattaaaaatacacagaactatttccctgaaattccgtaagtacatagtcaaaacacaatgtgaagaatttgtttaaaaacatcctgtagaaagtttataagaaaaccagtatttgaacaaattgtggaatataaatacaactatttttaagtaatttttttctctaatgtgttattttatttgttctgaaactaatctgattaaagcatatatattattttcttctcctttatatgtaatgaaagcacttataaagaaacaggaatcattagaccaggttgtaaagatgtcttggcctcccagacagtctttggaccactattttactggcctttgaaagaacaaagtttacttcaactaaaatgtttcttcctgtgaagacatatggtatcattttaatttaaggggcagatttccattcttttttggcatgtccttaaaaagaggatttgaaatcaactatatgctaccaagaactttaggatccaattttccaagccaccgtgaagcctcttatggctactattatagttcatgagatgttggacagcatttggtttgtttggtaagagaagaacaaatatggctaattgttaataaggtcccctggctatggtttttgttcttataacagagtttagaatatcagagcatttcttgaatcatacatcattattgtccagtgaattcaagaccaaatacaatatcgggagaaaatacaaactccctgtgtttaagaataggggattataatggctcaaattggttcatttgatttctaaaaataccatgacctttaaaaattcttttaatagatcatgttattggcagtatttatataaaaaccatggatttagaaaggtatatttagctttattataatagatacgttactattttggaaatatatatattttcacacctgtagtactcttccccatttcctctgacactcatgcagaatgagatcaggcatatttgtggttgacatactctagatagcttttccaacaaatctttgaaaagcaatcttggaaaggaattcattaactaaatggggtaaaaggtttctttttctttgagagttaagtccttcctcaaaaaattttcttatgctccataaaattgaggtagaatattttcattattcttgcagctaagcaagacagccatatgatgcaggttatgcagtgccttcatatctaaaacttttatactgcactttttaaagcttttatgttgaggaaaggaaaagggcatttgtctaaacatggattctgagttgtatatatttcctatcattctaaaaaagtgaatttgtgaagcaaagttttgccagatgttaaactttgaatttaatataccagattattaaaatattgtccattaactagttcatagattttaaaagtaaaatacttctgactgttaaaactatataaagaaaatctcatttgtctaattgcaattaaaagaaaaatgttaaaatattaaaatgaaaataaaagcattactttccaacaaagagctcagtggttaatataataggaacaacatatgtgcttattagaaataaagcatatacagccaaatcaccaa

SEQ ID NO: 355659 - DNA, 567 bp, Homo sapiens
tgaactctggtaggaactttataaggagcatttcactgcctttctggattgctatgagaagccaattttaaagccagtaagtggctaagtggacattaaaagggtctttgatgtcatctggtaatgtaattactgaatatgaaataatgctttggttttttaaccctagacttggaatggaaaattatctatgtgggctctgcagaaagtgaagaatacgatcaagttttagactctgttttagtgggtcctgttcccgcaggaaggcatatgtttgtatttcaggtaagattaatcttggtaaatgtgtatgccaaatatgtttcgaagtagactatattatctattatcttataacccttatccctttccttttgggttaaagaactgcttctgctgcattcactttaaatctgtttccatcatgttttaggcagtctctgtgtcacagaggaactcttacttcctggttttatatgctgagagatgttaatgtgacgtttactttagagagatgaacaacctacagtaaattttatactgtatcatggcacacagggtggtgaa

SEQ ID NO: 355660 - DNA, 1414 bp, Homo sapiens
gcttctctgatttgcttgggtaacctttattttctaagataaaggaggaaatgatacgatcccagtcttcattcttggtatcaagcaaaaccaggatcaggtcaaatcgacttaagagtgggctgccgagggcaatgttcacagacacggactcctgggggtcgtactggcctttggggttcgttgctgccaggatggtggtccttgtgttcagcttgcacacgaggtttgttctccgcctttgtcctaatccacaccagcaggtggagccgcagttaaagtttccgagtccattccgggagcgggagcccatcttgctggctgccgaggccctcgctggaggaggagggtcagaactcgggtgcagccaatcgagggcaacgctgctacttatcagagcagaatgggctgtagtttagtgaaataggaaagctgcaaaacactgtggagtgctcccgtgtaaataaaaagaggaaaaaagtttctcaagtcgccgctgcacgacgtctggccggcgctggagcgggggtctgcgctctcccgagcggccgcgcgctggactttattgtgccgcaaccagccccagttcccattgtttgtgtttttttcaaaatatggcaaaggttcaggtgaacaatgtagtggtgctggataacccttctcctttctacaacccgttccagttcgagatcaccttcgagtgcatcgaggacctgtctgaagacttggaatggaaaattatctatgtgggctctgcagaaagtgaagaatacgatcaagttttagactctgttttagtgggtcctgttcccgcaggaaggcatatgtttgtatttcaggctgatgcacctaatccaggactcattccagatgcagatgcagtaggcgtaactgttgtgctaattacttgtacctatcgaggacaagaatttattagagttggctattatgtaaataatgaatatactgagacagaattaagggaaaatccaccagtaaaaccagacttttctaagcttcaaaggaatattttggcatctaatcccagggtcacaagattccacattaattgggaagataacacagaaaaactggaagatgcagagagcagtaatccaaatctacagtcacttctttcaacagatgcattaccttcagcatcaaagggatggtccacatcagaaaactcactaaatgtcatgttagaatcccacatggactgcatgtgaccacctaccatccctttagtacaaattaagctattaaaaatacacagaactatttccctgaaattccgtaagtacatagtcaaaacacaatgtgaagaatttgtttaaaaacatcctgtagaaagtttataagaaaaccagtatttgaacaaattgtggaatataaatacaactatttttaagta

SEQ ID NO: 355661 - DNA, 2804 bp, Homo sapiens
gcttctctgatttgcttgggtaacctttattttctaagataaaggaggaaatgatacgatcccagtcttcattcttggtatcaagcaaaaccaggatcaggtcaaatcgacttaagagtgggctgccgagggcaatgttcacagacacggactcctgggggtcgtactggcctttggggttcgttgctgccaggatggtggtccttgtgttcagcttgcacacgaggtttgttctccgcctttgtcctaatccacaccagcaggtggagccgcagttaaagtttccgagtccattccgggagcgggagcccatcttgctggctgccgaggccctcgctggaggaggagggtcagaactcgggtgcagccaatcgagggcaacgctgctacttatcagagcagaatgggctgtagtttagtgaaataggaaagctgcaaaacactgtggagtgctcccgtgtaaataaaaagaggaaaaaagtttctcaagtcgccgctgcacgacgtctggccggcgctggagcgggggtctgcgctctcccgagcggccgcgcgctggactttattgtgccgcaaccagccccagttcccattgtttgtgtttttttcaaaatatggcaaaggttcaggtgaacaatgtagtggtgctggataacccttctcctttctacaacccgttccagttcgagatcaccttcgagtgcatcgaggacctgtctgaagacttggaatggaaaattatctatgtgggctctgcagaaagtgaagaatacgatcaagttttagactctgttttagtgggtcctgttcccgcaggaaggcatatgtttgtatttcaggctgatgcacctaatccaggactcattccagatgcagatgcagtaggcgtaactgttgtgctaattacttgtacctatcgaggacaagaatttattagagttggctattatgtaaataatgaatatactgagacagaattaagggaaaatccaccagtaaaaccagacttttctaagcttcaaaggaatattttggcatctaatcccagggtcacaagattccacattaattgggaagataacacagaatgcattaccttcagcatcaaagggatggtccacatcagaaaactcactaaatgtcatgttagaatcccacatggactgcatgtgaccacctaccatccctttagtacaaattaagctattaaaaatacacagaactatttccctgaaattccgtaagtacatagtcaaaacacaatgtgaagaatttgtttaaaaacatcctgtagaaagtttataagaaaaccagtatttgaacaaattgtggaatataaatacaactatttttaagtaatttttttctctaatgtgttattttatttgttctgaaactaatctgattaaagcatatatattattttcttctcctttatatgtaatgaaagcacttataaagaaacaggaatcattagaccaggttgtaaagatgtcttggcctcccagacagtctttggaccactattttactggcctttgaaagaacaaagtttacttcaactaaaatgtttcttcctgtgaagacatatggtatcattttaatttaaggggcagatttccattcttttttggcatgtccttaaaaagaggatttgaaatcaactatatgctaccaagaactttaggatccaattttccaagccaccgtgaagcctcttatggctactattatagttcatgagatgttggacagcatttggtttgtttggtaagagaagaacaaatatggctaattgttaataaggtcccctggctatggtttttgttcttataacagagtttagaatatcagagcatttcttgaatcatacatcattattgtccagtgaattcaagaccaaatacaatatcgggagaaaatacaaactccctgtgtttaagaataggggattataatggctcaaattggttcatttgatttctaaaaataccatgacctttaaaaattcttttaatagatcatgttattggcagtatttatataaaaaccatggatttagaaaggtatatttagctttattataatagatacgttactattttggaaatatatatattttcacacctgtagtactcttccccatttcctctgacactcatgcagaatgagatcaggcatatttgtggttgacatactctagatagcttttccaacaaatctttgaaaagcaatcttggaaaggaattcattaactaaatggggtaaaaggtttctttttctttgagagttaagtccttcctcaaaaaattttcttatgctccataaaattgaggtagaatattttcattattcttgcagctaagcaagacagccatatgatgcaggttatgcagtgccttcatatctaaaacttttatactgcactttttaaagcttttatgttgaggaaaggaaaagggcatttgtctaaacatggattctgagttgtatatatttcctatcattctaaaaaagtgaatttgtgaagcaaagttttgccagatgttaaactttgaatttaatataccagattattaaaatattgtccattaactagttcatagattttaaaagtaaaatacttctgactgttaaaactatataaagaaaatctcatttgtctaattgcaattaaaagaaaaatgttaaaatattaaaatgaaaataaaagcattactttccaacaaagagctcagtggttaatataataggaacaacatatgtgcttattagaaataaagcatatacagccaaatcaccaa

SEQ ID NO: 355662 - DNA, 240 bp, Homo sapiens
gcaggaggattgatggagccagggagattgaggctgcggtgagctgtgattataccactgcactccagcctgggtgacagagcaagaccttgtctcaaaaaaaggggagaaaatattggagctctgtaagaaatgtaattacataacatgactaggctaggaataatagttgcttcatcataatcgtgtaaacactggatattaatctattctcaattataaaactgtcctgaaggaatc

SEQ ID NO: 355663 - DNA, 435 bp, Homo sapiens
  misc_feature (43)..(43): n is a, c, g, or t
cccaacgtaatccaaacttgatgcatctgcccatagtagatcncagggaagacacgattatacacctcagccgcctgagatgggggtcagctctttatataaagggaaaccagaccaggcctaaagcccaccccctaccctcacccccacaatcctctcctgaaacttaaaaacagtgggaatataggaaagggaaccaaatctcattaattaattgttctcccccattaccccactgaatgaatggccatacaggctaagctgaataatgacaaagttgaaaggaccaatacagccccttttataaggattttgaatgttttgcaaatgtattggtccctgtgttgtattttgtagccttttcctgggcttcagctcccctacttcttgtatgtgtatgcatactgtagctaaccattaaagtcatgacacaca

SEQ ID NO: 355664 - DNA, 783 bp, Homo sapiens
aatccagctgtcttttattaagcaagacttagagatctgcaaaatgtagaaagacttagtgatgagtgtcaccagaaaatagttcatgtttcttacattagcacatagtgggtctgtttttaaaaatgaatatttttaaaatctaatttctaatgtggaaaattctgaaataaaacgcacagaaatgagaactctttggggtcccaagaaccactgctttaaaccaaagattaatttgaaagcctctgtcagaaacccaaaccctagccagttagaactgtcttcccatgttggcctttcagactaagtcctaagtcaaggtttcttaatttctaggtcgctatctctttttgaatgcaattgcaaatcagctccggtacccaaatagccacactcactacttcagttgcaccatgctgtacctttttgcagaggccaatacggaagccatccaagaacagatcacaaggtaagcgagcagcttattttttaaatgcttcaaaaggatctcctccctttcatcttttttttttcctctttatgctttcagtgttcagtgaaaatccgtttggttggttttttttttgtttttttgagacggagtgttgctctgtcactcagtctgcagtacagtggcgccatcttggctcactgcaacctccgcctcccaggttcaagcgattctcgtgccttagcctctcaagtagctgggattacaggcgcctgccaccacgcccagctaatttttgtattttagtagagacggggtttcactatgttggc

SEQ ID NO: 355665 - DNA, 288 bp, Homo sapiens
gaaaggaccaatacagccccttttaactttgtcattattcagcttagcctgtatggccattcattcagtggggtaatgggggagaacaatgaatgaatggccatacaggctaagctgaataatgacaaagttgaaaggaccaatacagccccttttataaggattttgaatgttttgcaaatgtattggtccctgtgttgtattttgtagccttttcctgggcttcagctcccctacttcttgtatgtgtatgcatactgtagctaaccattaaagtcatgacacaca

SEQ ID NO: 355666 - DNA, 4823 bp, Homo sapiens
ggcgggctagaggatcccggaactctgttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagtgctcctgacctctgataaagctgcagccaatttctcagatcgttctttgctgaagaacttgggacattggctaggaatgatcacattagctaaaaacaaacccatcttacacactgacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctaaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtactgcttccccacaacaaagagaaatgatggatcaggcagctgctcaattagctcaggacaattgtgagttggcttgctgttttattcagaagactgcagtagaaaaagcaggccctgagatggacaagagattagcaactgaatttgagctgagaaaacatgctaggcaagaaggacgcagatactgtgatcctgttgttttaacatatcaagctgaacggatgccagagcaaatcaggctgaaagttggtggtgtggacccaaagcagttggctgtttacgaagagtttgcacgcaatgttcctggcttcttacctacaaatgacttaagtcagcccacgggatttttagcccagcccatgaagcaagcttgggcaacagatgatgtagctcagatttatgataagtgtattacagaactggagcaacatctacatgccatcccaccaactttggccatgaaccctcaagctcaggctcttcgaagtctcttggaggttgtagttttatctcgaaactctcgggatgccatagctgctcttggattgctccaaaaggctgtagagggcttactagatgccacaagtggtgctgatgctgaccttctgctgcgctacagggaatgccacctcttggtcctaaaagctctgcaggatggccgggcatatgggtctccatggtgcaacaaacagatcacaaggtgcctaattgaatgtcgagatgaatataaatataatgtggaggctgtggagctgctaattcgcaatcatttggttaatatgcagcagtatgatcttcacctagcgcagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaaggattgccccagctgatggaagtagtgcgatccaactatgaagcaatgattgatcgtgctcatggaggcccaaactttatgatgcattctgggatctctcaagcctcagagtatgatgaccctccaggcctgagggagaaggcagagtatcttctgagggaatgggtgaatctctaccattcagcagcagctggccgcgacagtaccaaagctttctctgcatttgttggacagatgcaccagcaaggaatactgaagaccgatgatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtggacatgttgagtgaaattaacattgctccccggattctcaccaatttcactggagtaatgccacctcagttcaaaaaggatttggattcctatcttaaaactcgatcaccagtcactttcctgtctgatctgcgcagcaacctacaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagctccggtacccaaatagccacactcactacttcagttgcaccatgctgtacctttttgcagaggccaatacggaagccatccaagaacagatcacaagagttctcttggaacggttgattgtaaataggccacatccttggggtcttcttattaccttcattgagctgattaaaaacccagcgtttaagttctggaaccatgaatttgtacactgtgccccagaaatcgaaaagttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaacctttgtctggaacttcttggctttgtgcaagctgtgtccaaggcaagtacataaactggtaccttgtaatgaagaggcagctgatgccatgcacttgtctgagggcatagctccatgtcttctgacattcctggtgtcccaaagaatagcaaaaagccagtttgaatattatgtaacttatttttttaatgtggacaggggaccttgaaaatcactaagttattaaaaatgtggatgtgctagaattggatatgtccaggaacatgggaagggctcactattggaatcccatgagtttccattttgtctctacccaaacgtattccaaagctgactgcatttgtaccatcttatttcttttggggattatacacctcagccgcctgagatgggggtcagctctttatataaagggaaaccagaccaggcctaaagcccaccccctaccctcacccccacaatcctctcctgaaacttaaaaacagtgggaatataggaaagggaaccaaatctcattaattaattgttctcccccattaccccactgaatgaatggccatacaggctaagctgaataatgacaaagttgaaaggaccaatacagccccttttataaggattttgaatgttttgcaaatgtattggtccctgtgttgtattttgtagccttttcctgggcttcagctcccctacttcttgtatgtgtatgcatactgtagctaaccattaaagtcatgacacaca

SEQ ID NO: 355667 - DNA, 6200 bp, Homo sapiens
caggcgctgttggctgtctgcaagcttgtgcagtgagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccagtaggtggtcttggcacaggcagcctgactggtataggaactggtgctcttggactccctgcagtgaataacgacccttttgtacagaggaaactgggcacctctggactgaatcagcctacattccagcagacggacttgtctcaggtgtggccagaggcaaaccagcactttagtaaagagatagatgatgaagcaaacagctatttccagcgaatatataatcatccaccacatccaaccatgtctgttgatgaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagtgctcctgacctctgataaagctgcagccaatttctcagatcgttctttgctgaagaacttgggacattggctaggaatgatcacattagctaaaaacaaacccatcttacacactgacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctaaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtactgcttccccacaacaaagagaaatgatggatcaggcagctgctcaattagctcaggacaattgtgagttggcttgctgttttattcagaagactgcagtagaaaaagcaggccctgagatggacaagagattagcaactgaatttgagctgagaaaacatgctaggcaagaaggacgcagatactgtgatcctgttgttttaacatatcaagctgaacggatgccagagcaaatcaggctgaaagttggtggtgtggacccaaagcagttggctgtttacgaagagtttgcacgcaatgttcctggcttcttacctacaaatgacttaagtcagcccacgggatttttagcccagcccatgaagcaagcttgggcaacagatgatgtagctcagatttatgataagtgtattacagaactggagcaacatctacatgccatcccaccaactttggccatgaaccctcaagctcaggctcttcgaagtctcttggaggttgtagttttatctcgaaactctcgggatgccatagctgctcttggattgctccaaaaggctgtagagggcttactagatgccacaagtggtgctgatgctgaccttctgctgcgctacagggaatgccacctcttggtcctaaaagctctgcaggatggccgggcatatgggtctccatggtgcaacaaacagatcacaaggtgcctaattgaatgtcgagatgaatataaatataatgtggaggctgtggagctgctaattcgcaatcatttggttaatatgcagcagtatgatcttcacctagcgcagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaaggattgccccagctgatggaagtagtgcgatccaactatgaagcaatgattgatcgtgctcatggaggcccaaactttatgatgcattctgggatctctcaagcctcagagtatgatgaccctccaggcctgagggagaaggcagagtatcttctgagggaatgggtgaatctctaccattcagcagcagctggccgcgacagtaccaaagctttctctgcatttgttggacaggtagagcttttggaaagaaagatgcaccagcaaggaatactgaagaccgatgatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtggacatgttgagtgaaattaacattgctccccggattctcaccaatttcactggagtaatgccacctcagttcaaaaaggatttggattcctatcttaaaactcgatcaccagtcactttcctgtctgatctgcgcagcaacctacaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagctccggtacccaaatagccacactcactacttcagttgcaccatgctgtacctttttgcagaggccaatacggaagccatccaagaacagatcacaagagttctcttggaacggttgattgtaaataggccacatccttggggtcttcttattaccttcattgagctgattaaaaacccagcgtttaagttctggaaccatgaatttgtacactgtgccccagaaatcgaaaagttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaacctttgtctggaacttcttggctttgtgcaagctgtgtccaaggcaagtacataaactggtaccttgtaatgaagaggcagctgatgccatgcacttgtctgagggcatagctccatgtcttctgacattcctggtgtcccaaagaatagcaaaaagccagtttgaatattatgtaacttatttttttaatgtggacaggggaccttgaaaatcactaagttattaaaaatgtggatgtgctagaattggatatgtccaggaacatgggaagggctcactattggaatcccatgagtttccattttgtctctacccaaacgtattccaaagctgactgcatttgtaccatcttatttcttttggggattatacacctcagccgcctgagatgggggtcagctctttatataaagggaaaccagaccaggcctaaagcccaccccctaccctcacccccacaatcctctcctgaaacttaaaaacagtgggaatataggaaagggaaccaaatctcattaattaattgttctcccccattaccccactgaatgaatggccatacaggctaagctgaataatgacaaagttgaaaggaccaatacagccccttttataaggattttgaatgttttgcaaatgtattggtccctgtgttgtattttgtagccttttcctgggcttcagctcccctacttcttgtatgtgtatgcatactgtagctaaccattaaagtcatgacacaca

SEQ ID NO: 355668 - DNA, 6561 bp, Homo sapiens
caggcgctgttggctgtctgcaagcttgtgcagtgagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccagtaggtggtcttggcacaggcagcctgactggtataggaactggtgctcttggactccctgcagtgaataacgacccttttgtacagaggaaactgggcacctctggactgaatcagcctacattccagcagacggacttgtctcaggtgtggccagaggcaaaccagcactttagtaaagagatagatgatgaagcaaacagctatttccagcgaatatataatcatccaccacatccaaccatgtctgttgatgaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagtgctcctgacctctgataaagctgcagccaatttctcagatcgttctttgctgaagaacttgggacattggctaggaatgatcacattagctaaaaacaaacccatcttacacactgacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctaaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtactgcttccccacaacaaagagaaatgatggatcaggcagctgctcaattagctcaggacaattgtgagttggcttgctgttttattcagaagactgcagtagaaaaagcaggccctgagatggacaagagattagcaactgaatttgagctgagaaaacatgctaggcaagaaggacgcagatactgtgatcctgttgttttaacatatcaagctgaacggatgccagagcaaatcaggctgaaagttggtggtgtggacccaaagcagttggctgtttacgaagagtttgcacgcaatgttcctggcttcttacctacaaatgacttaagtcagcccacgggatttttagcccagcccatgaagcaagcttgggcaacagatgatgtagctcagatttatgataagtgtattacagaactggagcaacatctacatgccatcccaccaactttggccatgaaccctcaagctcaggctcttcgaagtctcttggaggttgtagttttatctcgaaactctcgggatgccatagctgctcttggattgctccaaaaggctgtagagggcttactagatgccacaagtggtgctgatgctgaccttctgctgcgctacagggaatgccacctcttggtcctaaaagctctgcaggatggccgggcatatgggtctccatggtgcaacaaacagatcacaaggtgcctaattgaatgtcgagatgaatataaatataatgtggaggctgtggagctgctaattcgcaatcatttggttaatatgcagcagtatgatcttcacctagcgcagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaaggattgccccagctgatggaagtagtgcgatccaactatgaagcaatgattgatcgtgctcatggaggcccaaactttatgatgcattctgggatctctcaagcctcagagtatgatgaccctccaggcctgagggagaaggcagagtatcttctgagggaatgggtgaatctctaccattcagcagcagctggccgcgacagtaccaaagctttctctgcatttgttggacagatgcaccagcaaggaatactgaagaccgatgatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtggacatgttgagtgaaattaacattgctccccggattctcaccaatttcactggagtaatgccacctcagttcaaaaaggatttggattcctatcttaaaactcgatcaccagtcactttcctgtctgatctgcgcagcaacctacaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagctccggtacccaaatagccacactcactacttcagttgcaccatgctgtacctttttgcagaggccaatacggaagccatccaagaacagatcacaagagttctcttggaacggttgattgtaaataggccacatccttggggtcttcttattaccttcattgagctgattaaaaacccagcgtttaagttctggaaccatgaatttgtacactgtgccccagaaatcgaaaagttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaacctttgtctggaacttcttggctttgtgcaagctgtgtccaaggcaagtacataaactggtaccttgtaatgaagaggcagctgatgccatgcacttgtctgagggcatagctccatgtcttctgacattcctggtgtcccaaagaatagcaaaaagccagtttgaatattatgtaacttatttttttaatgtggacaggggaccttgaaaatcactaagttattaaaaatgtggatgtgctagaattggatatgtccaggaacatgggaagggctcactattggaatcccatgagtttccattttgtctctacccaaacgtattccaaagctgactgcatttgtaccatcttatttcttttggggattatacacctcagccgcctgagatgggggtcagctctttatataaagggaaaccagaccaggcctaaagcccaccccctaccctcacccccacaatcctctcctgaaacttaaaaacagtgggaatataggaaagggaaccaaatctcattaattaattgttctcccccattaccccactgaatgaatggccatacaggctaagctgaataatgacaaagttgaaaggaccaatacagccccttttataaggattttgaatgttttgcaaatgtattggtccctgtgttgtattttgtagccttttcctgggcttcagctcccctacttcttgtatgtgtatgcatactgtagctaaccattaaagtcatgacacacacatgagtccactgtgcctttctcagtagcagcaggcagtgctggtggtgaggaggaaaagtggacaatccagccctgtagaccttggggccatggggaaccaacaactaacttcttgctgaatgattgattgattggattgataggtcattcctactactaagctggcatgtttaaggaaattgtatttttcttcctatttatttcaacactggacaaatgctggagcaggtttatctggttaagctgagtttaaaatacccagttttaatatccttttcccccaggtatttttttttttttttaaagaaaatgagtagatacgtatttaaaaacttaacccacttaaaatttgccttacctttcatgactgtcaagtttta

SEQ ID NO: 355669 - DNA, 6213 bp, Homo sapiens
caggcgctgttggctgtctgcaagcttgtgcagtgagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccagtaggtggtcttggcacaggcagcctgactggtataggaactggtgctcttggactccctgcagtgaataacgacccttttgtacagaggaaactgggcacctctggactgaatcagcctacattccagcagacggacttgtctcaggtgtggccagaggcaaaccagcactttagtaaagagatagatgatgaagcaaacagctatttccagcgaatatataatcatccaccacatccaaccatgtctgttgatgaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagtgctcctgacctctgataaagctgcagccaatttctcagatcgttctttgctgaagaacttgggacattggctaggaatgatcacattagctaaaaacaaacccatcttacacactgacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctaaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtactgcttccccacaacaaagagaaatgatggatcaggcagctgctcaattagctcaggacaattgtgagttggcttgctgttttattcagaagactgcagtagaaaaagcaggccctgagatggacaagagattagcaactgaatttgagctgagaaaacatgctaggcaagaaggacgcagatactgtgatcctgttgttttaacatatcaagctgaacggatgccagagcaaatcaggctgaaagttggtggtgtggacccaaagcagttggctgtttacgaagagtttgcacgcaatgttcctggcttcttacctacaaatgacttaagtcagcccacgggatttttagcccagcccatgaagcaagcttgggcaacagatgatgtagctcagatttatgataagtgtattacagaactggagcaacatctacatgccatcccaccaactttggccatgaaccctcaagctcaggctcttcgaagtctcttggaggttgtagttttatctcgaaactctcgggatgccatagctgctcttggattgctccaaaaggctgtagagggcttactagatgccacaagtggtgctgatgctgaccttctgctgcgctacagggaatgccacctcttggtcctaaaagctctgcaggatggccgggcatatgggtctccatggtgcaacaaacagatcacaaggtgcctaattgaatgtcgagatgaatataaatataatgtggaggctgtggagctgctaattcgcaatcatttggttaatatgcagcagtatgatcttcacctagcgcagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaaggattgccccagctgatggaagtagtgcgatccaactatgaagcaatgattgatcgtgctcatggaggcccaaactttatgatgcattctgggatctctcaagcctcagagtatgatgaccctccaggcctgagggagaaggcagagtatcttctgagggaatgggtgaatctctaccattcagcagcagctggccgcgacagtaccaaagctttctctgcatttgttggacagatgcaccagcaaggaatactgaagaccgatgatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtggacatgttgagtgaaattaacattgctccccggattctcaccaatttcactggagtaatgccacctcagttcaaaaaggatttggattcctatcttaaaactcgatcaccagtcactttcctgtctgatctgcgcagcaacctacaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagctccggtacccaaatagccacactcactacttcagttgcaccatgctgtacctttttgcagaggccaatacggaagccatccaagaacagatcacaagagttctcttggaacggttgattgtaaataggccacatccttggggtcttcttattaccttcattgagctgattaaaaacccagcgtttaagttctggaaccatgaatttgtacactgtgccccagaaatcgaaaagttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaacctttgtctggaacttcttggctttgtgcaagctgtgtccaaggcaagtacataaactggtaccttgtaatgaagaggcagctgatgccatgcacttgtctgagggcatagctccatgtcttctgacattcctggtgtcccaaagaatagcaaaaagccagtttgaatattatgtaacttatttttttaatgtggacaggggaccttgaaaatcactaagttattaaaaatgtggatgtgctagaattggatatgtccaggaacatgggaagggctcactattggaatcccatgagtttccattttgtctctacccaaacgtattccaaagctgactgcatttgtaccatcttatttcttttggggattatacacctcagccgcctgagatgggggtcagctctttatataaagggaaaccagaccaggcctaaagcccaccccctaccctcacccccacaatcctctcctgaaacttaaaaacagtgggaatataggaaagggaaccaaatctcattaattaattgttctcccccattaccccactgaatgaatggccatacaggctaagctgaataatgacaaagttgaaaggaccaatacagccccttttataaggattttgaatgttttgcaaatgtattggtccctgtgttgtattttgtagccttttcctgggcttcagctcccctacttcttgtatgtgtatgcatactgtagctaaccattaaagtcatgacacacaaaatccttataaaaggggctgtattgtcgacgcg

SEQ ID NO: 355670 - DNA, 6126 bp, Homo sapiens
caggcgctgttggctgtctgcaagcttgtgcagtgagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccagtaggtggtcttggcacaggcagcctgactggtataggaactggtgctcttggactccctgcagtgaataacgacccttttgtacagaggaaactgggcacctctggactgaatcagcctacattccagcagacggacttgtctcaggtgtggccagaggcaaaccagcactttagtaaagagatagatgatgaagcaaacagctatttccagcgaatatataatcatccaccacatccaaccatgtctgttgatgaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagtgctcctgacctctgataaagctgcagccaatttctcagatcgttctttgctgaagaacttgggacattggctaggaatgatcacattagctaaaaacaaacccatcttacacactgacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctaaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtactgcttccccacaacaaagagaaatgatggatcaggcagctgctcaattagctcaggacaattgtgagttggcttgctgttttattcagaagactgcagtagaaaaagcaggccctgagatggacaagagattagcaactgaatttgagctgagaaaacatgctaggcaagaaggacgcagatactgtgatcctgttgttttaacatatcaagctgaacggatgccagagcaaatcaggctgaaagttggtggtgtggacccaaagcagttggctgtttacgaagagtttgcacgcaatgttcctggcttcttacctacaaatgacttaagtcagcccacgggatttttagcccagcccatgaagcaagcttgggcaacagatgatgtagctcagatttatgataagtgtattacagaactggagcaacatctacatgccatcccaccaactttggccatgaaccctcaagctcaggctcttcgaagtctcttggaggttgtagttttatctcgaaactctcgggatgccatagctgctcttggattgctccaaaaggctgtagagggcttactagatgccacaagtggtgctgatgctgaccttctgctgcgctacagggaatgccacctcttggtcctaaaagctctgcaggatggccgggcatatgggtctccatggtgcaacaaacagatcacaaggtgcctaattgaatgtcgagatgaatataaatataatgtggaggctgtggagctgctaattcgcaatcatttggttaatatgcagcagtatgatcttcacctagcgcagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaaggattgccccagctgatggaagtagtgcgatccaactatgaagcaatgattgatcgtgctcatggaggcccaaactttatgatgcattctgggatctctcaagcctcagagtatgatgaccctccaggcctgagggagaaggcagagtatcttctgagggaatgggtgaatctctaccattcagcagcagctggccgcgacagtaccaaagctttctctgcatttgttggacagatgcaccagcaaggaatactgaagaccgatgatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtggacatgttgagtgaaattaacattgctccccggattctcaccaatttcactggagtaatgccacctcagttcaaaaaggatttggattcctatcttaaaactcgatcaccagtcactttcctgtctgatctgcgcagcaacctacaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagctccggtacccaaatagccacactcactacttcagttgcaccatgctgtacctttttgcagaggccaatacggaagccatccaagaacagatcacaagagttctcttggaacggttgattgtaaataggccacatccttggggtcttcttattaccttcattgagctgattaaaaacccagcgtttaagttctggaaccatgaatttgtacactgtgccccagaaatcgaaaataatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaacctttgtctggaacttcttggctttgtgcaagctgtgtccaaggcaagtacataaactggtaccttgtaatgaagaggcagctgatgccatgcacttgtctgagggcatagctccatgtcttctgacattcctggtgtcccaaagaatagcaaaaagccagtttgaatattatgtaacttatttttttaatgtggacaggggaccttgaaaatcactaagttattaaaaatgtggatgtgctagaattggatatgtccaggaacatgggaagggctcactattggaatcccatgagtttccattttgtctctacccaaacgtattccaaagctgactgcatttgtaccatcttatttcttttggggattatacacctcagccgcctgagatgggggtcagctctttatataaagggaaaccagaccaggcctaaagcccaccccctaccctcacccccacaatcctctcctgaaacttaaaaacagtgggaatataggaaagggaaccaaatctcattaattaattgttctcccccattaccccactgaatgaatggccatacaggctaagctgaataatgacaaagttgaaaggaccaatacagccccttttataaggattttgaatgttttgcaaatgtattggtccctgtgttgtattttgtagccttttcctgggcttcagctcccctacttcttgtatgtgtatgcatactgtagctaaccattaaagtcatgacacaca

SEQ ID NO: 355671 - DNA, 10600 bp, Homo sapiens
caggcgctgttggctgtctgcaagcttgtgcagtgagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccagtaggtggtcttggcacaggcagcctgactggtataggaactggtgctcttggactccctgcagtgaataacgacccttttgtacagaggaaactgggcacctctggactgaatcagcctacattccagcagacggacttgtctcaggtgtggccagaggcaaaccagcactttagtaaagagatagatgatgaagcaaacagctatttccagcgaatatataatcatccaccacatccaaccatgtctgttgatgaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagtgctcctgacctctgataaagctgcagccaatttctcagatcgttctttgctgaagaacttgggacattggctaggaatgatcacattagctaaaaacaaacccatcttacacactgacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctaaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtactgcttccccacaacaaagagaaatgatggatcaggcagctgctcaattagctcaggacaattgtgagttggcttgctgttttattcagaagactgcagtagaaaaagcaggccctgagatggacaagagattagcaactgaatttgagctgagaaaacatgctaggcaagaaggacgcagatactgtgatcctgttgttttaacatatcaagctgaacggatgccagagcaaatcaggctgaaagttggtggtgtggacccaaagcagttggctgtttacgaagagtttgcacgcaatgttcctggcttcttacctacaaatgacttaagtcagcccacgggatttttagcccagcccatgaagcaagcttgggcaacagatgatgtagctcagatttatgataagtgtattacagaactggagcaacatctacatgccatcccaccaactttggccatgaaccctcaagctcaggctcttcgaagtctcttggaggttgtagttttatctcgaaactctcgggatgccatagctgctcttggattgctccaaaaggctgtagagggcttactagatgccacaagtggtgctgatgctgaccttctgctgcgctacagggaatgccacctcttggtcctaaaagctctgcaggatggccgggcatatgggtctccatggtgcaacaaacagatcacaaggtgcctaattgaatgtcgagatgaatataaatataatgtggaggctgtggagctgctaattcgcaatcatttggttaatatgcagcagtatgatcttcacctagcgcagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaaggattgccccagctgatggaagtagtgcgatccaactatgaagcaatgattgatcgtgctcatggaggcccaaactttatgatgcattctgggatctctcaagcctcagagtatgatgaccctccaggcctgagggagaaggcagagtatcttctgagggaatgggtgaatctctaccattcagcagcagctggccgcgacagtaccaaagctttctctgcatttgttggacagatgcaccagcaaggaatactgaagaccgatgatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtggacatgttgagtgaaattaacattgctccccggattctcaccaatttcactggagtaatgccacctcagttcaaaaaggatttggattcctatcttaaaactcgatcaccagtctttcaaacagttccatgcaaacatcacatttttcaaatggaaaaacttccaactggaccagaagttcatactgctaatgtacttttcattgaaacaatttttagtaagtacaaatacatggcattaaggttcagaacctaatataggcctgacaatcaagtccttattttctggaggaaggcctcaagtccaataaatttccagtaacaatgtttttacaaatcaatttaataataaggggttttattttccttcatgtttttgtttttagcattctagtcttaagactagattagaagttagctcaattccccaaaaggcaaatggtttttctttgcagtatgaaataatccacaaaaaaacctcttccccaaactaattcctaataaccaatctgtgcttaagatgtatctttttctatacaatgtaaacggtaacttaggtaaaatgtacccatgaacattaaaactagtcattagaaagacttaactagctttataatttaagttttaaaacataaatatttgcagcttgatcttctgttgacaatgattgtcggagcctagaattcaacatttacaatgtccattcatgcacacaaaacacataccattatcacacaacttactcctcatgtcttaagagaagaatcttccgcttctttaaatctttggcctcccagtcaatgccatgttcaaacaacttttaactcaaacttcactctcagatttttaacaagctttccacccacacgttattaatgcttttcctaatctttcatgttgtactgccaaatctgaaacctgcctcaaagagatcatcagatttttaaaaaatgaaatataaagtggttatttcaaaacggagtatgggaggtcagaattcaagattccctaatgggatcatattttattttactgcaatgaatgactgctatcagtaagaaaaatcctctattggattctttcacactctttggcaactggccaaagaacctcaaaaatgttttggagtacatgcgctttttcatacaaagtgccctcataggaacaccaggatagctgcaattcatttgaggcctcacctatagaaagaggctatcacacagacagccaggacacccaccagtttgtggagatccctgagaaagtatgattttaaaaaatctggactgtacttgtttcaccagcctttttcactgtataggaaagttgcagctggtctaccagcactcatactacctttcttatcctaggtttgccgcgtaatagctatggctttccaatctcccaagtgatattctataaacttgaaggaataattatatctcctaattccaggtttgtagtttccaaatatcacttacagttctctttattgtaaagtagccatatgaacaccaaccatctatgagaaaaggttctcctcaaacatttaacactctacaattaggaattagctgtaccaaaacacatgaaaaaaaaaactgatggttggtatttgagataaaaatttgttcgacatgcaacctagtggtttatttattgcaaaatcaaaactgatagctgtgaatttactacatccattcgaaataaataagttatatgaaatacagattctggcatagatataagatgtaaaaatcaaaatcaatagattgaacctgcatatttcatttgctcacaaacttgcacacactattattctgcaaaatagacaactgcagcaaagaaaaagaaaactgcccttttgcaaacaagtctaaaagcatccctccaaagacgccaaaaaataaacatgcatatatatatgtataaagtgttactgttcaacacaaatgctatttctaggaaaaatttaactgcataggcaaaaaaacataaacagaaaccaaaagaaaaaaaaaatgtgcaacatcttaagccattaaagcaccaaaataaaaaacacaccaaaatcactgtttttatgacgattaacatacacaaataaaaaatattgatcaaaactcaggaagtaaatacttggactgatagactgtctattgctgggggaatttttcttcaatttaaatgtcttctcatctctaaaaaaaaatcttaaagtgctaactttatataaagcaggcaaattcttcaagtaatttgctattaagtaagccaattttttatagatctcaataaaaaacgaagaataaactaaagtgaaacaggaagataagacatggagaaaaaaatgacaagttgtagctggacaaagcaataaaatgctgttataccatcttagccttctaatttcaattaaacacataagctaacagatacctgctggtttagtacactctcttagatttactaaaatttacacaacaatcaacaggtatacataaaaagtcctaaggaaaagaatgccacttaaaaatcaacatcagatactaattaaagcaatcttaaaaggttgtctgctatcataaatgaatataaaatgtaatataccttacaaactaagaactgaaaccttgttcaaagtttcattactcctgcccttgagctgcttcttcaagatagtaacacattaaccaaatggcgattgaggtgtttgctgtaatcttttccctttctgaaagaacgatcacagaagatacaaacaaaatctcccttagccgctttgactgccaaggcttcctttgcattttttctgctagattcttgtggaactggccgagccccatgcaatccagaatcatcactaccctctgacatgttgtcacttaggtcacttccttcatggctgtggatgccttcatcttcatcaatttcctgagactcatttgctgccattgtagcaggaggtgatgccagtgcagttttggacactgcttcacgttcttctactgctgaagggggaagcattggtgaaactggttcttcaactgttgaatttataccagtgagattctctcttgtgttctgatcagtgtccattttcatttcacaaactatactgtcagtctgatgtttaccatttaaagtttcaccctctggcgtattcaagttttgtccagaggatgaaatatgggtagattcgttgatattagcagcaagaccaggtaggctctcatctgcctcttctgctcctactttctgaagaggggcttctttatttccttcacctgtgttgagtaatttttggtctcctgatgcctcttctcttaaattttcctttggcagtggtggtgatggtggtgagagatcctctgtgcttacactttcctttagaagccagctatctttaacaggcactaagccaacttcaataaggacttgctccttccgtgccctttcactctgcatgttagacttttcctttttatcttttcggagaggaggctttttggaaattggctccatgtgaaggggaggctctctgggaggaggtagctccctctgagcaggctccttctgaaccacccccatgggaggagacaactccatctgaacaggctccttctggaccacctctatgggaggagacagctctatcttaacaggttccttctggaccacctccatgggaggagacagctctatctgaacaggctccttctggaccacctccatgggaggagacagctccatctgaacaggctccttctggaccacctgcatgggagcagattctacctgggcaacctccatctgagcaggttccatgggagcaggccccatttgggcaacctccgtctgagcagtctccatgggaggaggcagctccatgtgagcaagtacaatttgggcacccaccatctgagcaggctccacgggaggcagcagctccttctgagcaggcccctcctgaaccacctccatctgaacaggctcgtcaggagcaggccgtatctgggcaccctccatctgagcatgctccatgggaggtggcggctccacctgaacgggccccttctgaaccgcctctgtgggagcaggccccatctgaggagggtccatctgagcagatcccttctcaacaggttccttctgaggaggcttactgcttttcttacttgatttatttttcagagttttcttctttgtactttttttcatgcaagtattttgctttttattctcctccactttgctgtcaccctttggcacttcctgactattatttttggatttgctttctaccttctttttcttttttgttgaagattcctcatcattcacaggaccatgtaaagaatggctgtcaacttccagcttccttttgcttttcttagttttactgaatttttctgaattgcttcctgtatgcacatccatctctttcacctctgttactgattttcgagttctggtagtcacctggatcactgacacattattagaaggctttttctcttttgagacatctcttttctctgctttgacggacttttcatttttctttccagccacatccccttttatttttgtttgttctatttctgttttttcattggtaatattatcaggcaagtcagcctctcgttttttggttttctttagtttcacttttgagacatccattgttttattaggacaagtaggatgcttagatttgaagtgatactgtagattacacttcttggaagctgcatagtcacatacagggcaattgaactgccgtgggttcacatgtagctctacatgttttttgaagttgcttctatctgctgttttgtaatcacagtgtgggcaattaagaggtttaggcccattgtgaacctgtcttgcatggcgggttacttcatgttgattagaggccacataactgcactgatcacatttaaatggcttctcacctgaatgagtacgcatatgtctagttagatgagtcttctgagaacttgagtaaggacaaagttcacatttatatgggcgttctcctgtatgagttctaacatgctgaacataattgttttttctgtctgaaaaatagttgcattttccacatgtgtatactttccttggaaaatggtttcttaaatgtttcctccagtgatactcgctcactgttgtgtatgtgcaaatgatacacttgtagactcgctcattatccccagctctggtgtggtgtttcaggtgtgctgtatagtgatcatatcgattagtattgtagccgcagcggtcacagcgaatggggcccttgagaaatctccctcttctgcagtggaagagagattccctgcttttgcctgcttctctgcactctcttccaacaaaaaatttcttagcactgtgaactctgatgtgatgcacaaactgttcttcagattctgcttcatattggcatggcttacagcgaaagggtttggtcttcgagctcttgcctttgtcctccgctccaggtgtttcagggggaagatctttatttgaactgtaaatatctggagcacctgatgcctcaaatacaggctgaggttctacgacgctgagttccaaacttctcagttccatgttttccagtccatgaggttcaccttttatatcagcagactcttcaagtccttctccttcttcactatctgaaaagttgttatccccaaccggcatcagttctgccatctgtctttcttcaccgaccaggtaatcacagcagctgccatttacttccccagttaaggccacatttgccagcataataagctgaggtgcggccagttcagctttggaaaggtcatgcaagtcatacatgtcgttaggcagggccattccaatgttgccactgctggtaaacagccctcctcctccagaagactgccccattacctgggtggccataactgtattcggccttcctcggtgaggaggggcgggcgaccctgagtcgccgctccttctccgactacttttctttgttgctggagtttcgggggagaggtgggggagggtggtaaagttgggtgctggggccgtcgtggaccaagaaggcctcgtgccgaattc

SEQ ID NO: 355672 - DNA, 5271 bp, Homo sapiens
caggcgctgttggctgtctgcaagcttgtgcagtgagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccagtaggtggtcttggcacaggcagcctgactggtataggaactggtgctcttggactccctgcagtgaataacgacccttttgtacagaggaaactgggcacctctggactgaatcagcctacattccagcagacggacttgtctcaggtgtggccagaggcaaaccagcactttagtaaagagatagatgatgaagcaaacagctatttccagcgaatatataatcatccaccacatccaaccatgtctgttgatgaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagtgctcctgacctctgataaagctgcagccaatttctcagatcgttctttgctgaagaacttgggacattggctaggaatgatcacattagctaaaaacaaacccatcttacacactgacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctaaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtactgcttccccacaacaaagagaaatgatggatcaggcagctgctcaattagctcaggacaattgtgagttggcttgctgttttattcagaagactgcagtagaaaaagcaggccctgagatggacaagagattagcaactgaatttgagctgagaaaacatgctaggcaagaaggacgcagatactgtgatcctgttgttttaacatatcaagctgaacggatgccagagcaaatcaggctgaaagttggtggtgtggacccaaagcagttggctgtttacgaagagtttgcacgcaatgttcctggcttcttacctacaaatgacttaagtcagcccacgggatttttagcccagcccatgaagcaagcttgggcaacagatgatgtagctcagatttatgataagtgtattacagaactggagcaacatctacatgccatcccaccaactttggccatgaaccctcaagctcaggctcttcgaagtctcttggaggttgtagttttatctcgaaactctcgggatgccatagctgctcttggattgctccaaaaggctgtagagggcttactagatgccacaagtggtgctgatgctgaccttctgctgcgctacagggaatgccacctcttggtcctaaaagctctgcaggatggccgggcatatgggtctccatggtgcaacaaacagatcacaaggtgcctaattgaatgtcgagatgaatataaatataatgtggaggctgtggagctgctaattcgcaatcatttggttaatatgcagcagtatgatcttcacctagcgcagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaaggattgccccagctgatggaagtagtgcgatccaactatgaagcaatgattgatcgtgctcatggaggcccaaactttatgatgcattctgggatctctcaagcctcagagtatgatgaccctccaggcctgagggagaaggcagagtatcttctgagggaatgggtgaatctctaccattcagcagcagctggccgcgacagtaccaaagctttctctgcatttgttggacagatgcaccagcaaggaatactgaagaccgatgatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtggacatgttgagtgaaattaacattgctccccggattctcaccaatttcactggagtaatgccacctcagttcaaaaaggatttggattcctatcttaaaactcgatcaccagtcactttcctgtctgatctgcgcagcaacctacaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagctccggtacccaaatagccacactcactacttcagttgcaccatgctgtacctttttgcagaggccaatacggaagccatccaagaacagatcacaaggtaagcgagcagcttattttttaaatgcttcaaaaggatctcctccctttcatcttttttttttcctctttatgctttcagtgttcagtgaaaatccgtttggttggttttttttttgtttttttgagacggagtgttgctctgtcactcagtctgcagtacagtggcgccatcttggctcactgcaacctccgcctcccaggttcaagcgattctcgtgccttagcctctcaagtagctgggattacaggcgcctgccaccacgcccagctaatttttgtattttagtagagacggggtttcactatgttggc

SEQ ID NO: 355673 - DNA, 1691 bp, Homo sapiens
aatccagctgtcttttattaagcaagacttagagatctgcaaaatgtagaaagacttagtgatgagtgtcaccagaaaatagttcatgtttcttacattagcacatagtgggtctgtttttaaaaatgaatatttttaaaatctaatttctaatgtggaaaattctgaaataaaacgcacagaaatgagaactctttggggtcccaagaaccactgctttaaaccaaagattaatttgaaagcctctgtcagaaacccaaaccctagccagttagaactgtcttcccatgttggcctttcagactaagtcctaagtcaaggtttcttaatttctaggtcgctatctctttttgaatgcaattgcaaatcagctccggtacccaaatagccacactcactacttcagttgcaccatgctgtacctttttgcagaggccaatacggaagccatccaagaacagatcacaagagttctcttggaacggttgattgtaaataggccacatccttggggtcttcttattaccttcattgagctgattaaaaacccagcgtttaagttctggaaccatgaatttgtacactgtgccccagaaatcgaaaagttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaacctttgtctggaacttcttggctttgtgcaagctgtgtccaaggcaagtacataaactggtaccttgtaatgaagaggcagctgatgccatgcacttgtctgagggcatagctccatgtcttctgacattcctggtgtcccaaagaatagcaaaaagccagtttgaatattatgtaacttatttttttaatgtggacaggggaccttgaaaatcactaagttattaaaaatgtggatgtgctagaattggatatgtccaggaacatgggaagggctcactattggaatcccatgagtttccattttgtctctacccaaacgtattccaaagctgactgcatttgtaccatcttatttcttttggggattatacacctcagccgcctgagatgggggtcagctctttatataaagggaaaccagaccaggcctaaagcccaccccctaccctcacccccacaatcctctcctgaaacttaaaaacagtgggaatataggaaagggaaccaaatctcattaattaattgttctcccccattaccccactgaatgaatggccatacaggctaagctgaataatgacaaagttgaaaggaccaatacagccccttttataaggattttgaatgttttgcaaatgtattggtccctgtgttgtattttgtagccttttcctgggcttcagctcccctacttcttgtatgtgtatgcatactgtagctaaccattaaagtcatgacacaca

SEQ ID NO: 355674 - DNA, 1537 bp, Homo sapiens
tttgtgtgcccatgtactctgggctttatgtggcttcctctcccccatcaccccttattctgaacagctgtgaggtagataccattatctgcactttatataaatacttagtcttctacggctaagagcagggttcaaacccaggtattccaacctgtgctatttggagtatattaatccacctgtctttactaaaggtgaaaacttttgcatgtggttcaatagtcagggagaagttagaaaaaaagtaatggaagaataatcatgaatttgtatgcttctatacattaactagctctttctccctttttccagagttctcttggaacggttgattgtaaataggccacatccttggggtcttcttattaccttcattgagctgattaaaaacccagcgtttaagttctggaaccatgaatttgtacactgtgccccagaaatcgaaaagttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaacctttgtctggaacttcttggctttgtgcaagctgtgtccaaggcaagtacataaactggtaccttgtaatgaagaggcagctgatgccatgcacttgtctgagggcatagctccatgtcttctgacattcctggtgtcccaaagaatagcaaaaagccagtttgaatattatgtaacttatttttttaatgtggacaggggaccttgaaaatcactaagttattaaaaatgtggatgtgctagaattggatatgtccaggaacatgggaagggctcactattggaatcccatgagtttccattttgtctctacccaaacgtattccaaagctgactgcatttgtaccatcttatttcttttggggattatacacctcagccgcctgagatgggggtcagctctttatataaagggaaaccagaccaggcctaaagcccaccccctaccctcacccccacaatcctctcctgaaacttaaaaacagtgggaatataggaaagggaaccaaatctcattaattaattgttctcccccattaccccactgaatgaatggccatacaggctaagctgaataatgacaaagttgaaaggaccaatacagccccttttataaggattttgaatgttttgcaaatgtattggtccctgtgttgtattttgtagccttttcctgggcttcagctcccctacttcttgtatgtgtatgcatactgtagctaaccattaaagtcatgacacaca

SEQ ID NO: 355675 - DNA, 4587 bp, Homo sapiens
caggcgctgttggctgtctgcaagcttgtgcagtgagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccagtaggtggtcttggcacaggcagcctgactggtataggaactggtgctcttggactccctgcagtgaataacgacccttttgtacagaggaaactgggcacctctggactgaatcagcctacattccagcagacggacttgtctcaggtgtggccagaggcaaaccagcactttagtaaagagatagatgatgaagcaaacagctatttccagcgaatatataatcatccaccacatccaaccatgtctgttgatgaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagtgctcctgacctctgataaagctgcagccaatttctcagatcgttctttgctgaagaacttgggacattggctaggaatgatcacattagctaaaaacaaacccatcttacacactgacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctaaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtactgcttccccacaacaaagagaaatgatggatcaggcagctgctcaattagctcaggacaattgtgagttggcttgctgttttattcagaagactgcagtagaaaaagcaggccctgagatggacaagagattagcaactgaatttgagctgagaaaacatgctaggcaagaaggacgcagatactgtgatcctgttgttttaacatatcaagctgaacggatgccagagcaaatcaggctgaaagttggtggtgtggacccaaagcagttggctgtttacgaagagtttgcacgcaatgttcctggcttcttacctacaaatgacttaagtcagcccacgggatttttagcccagcccatgaagcaagcttgggcaacagatgatgtagctcagatttatgataagtgtattacagaactggagcaacatctacatgccatcccaccaactttggccatgaaccctcaagctcaggctcttcgaagtctcttggaggttgtagttttatctcgaaactctcgggatgccatagctgctcttggattgctccaaaaggctgtagagggcttactagatgccacaagtggtgctgatgctgaccttctgctgcgctacagggaatgccacctcttggtcctaaaagctctgcaggatggccgggcatatgggtctccatggtgcaacaaacagatcacaaggtgcctaattgaatgtcgagatgaatataaatataatgtggaggctgtggagctgctaattcgcaatcatttggttaatatgcagcagtatgatcttcacctagcgcagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaaggattgccccagctgatggaagtagtgcgatccaactatgaagcaatgattgatcgtgctcatggaggcccaaactttatgatgcattctgggatctctcaagcctcagagtatgatgaccctccaggcctgagggagaaggcagagtatcttctgagggaatgggtgaatctctaccattcagcagcagctggccgcgacagtaccaaagctttctctgcatttgttggacagatgcaccagcaaggaatactgaagaccgatgatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgaccatgatcgagtcagtgacgagagaaaaaagttcgagtcagcataggaaagaaccacaaagaaggccattacaatcacgatcagtgaaacagaaaatgagacccaaatcagtagat

SEQ ID NO: 355676 - DNA, 1683 bp, Homo sapiens
tttgtgtgcccatgtactctgggctttatgtggcttcctctcccccatcaccccttattctgaacagctgtgaggtagataccattatctgcactttatataaatacttagtcttctacggctaagagcagggttcaaacccaggtattccaacctgtgctatttggagtatattaatccacctgtctttactaaaggtgaaaacttttgcatgtggttcaatagtcagggagaagttagaaaaaaagtaatggaagaataatcatgaatttgtatgcttctatacattaactagctctttctccctttttccagagttctcttggaacggttgattgtaaataggccacatccttggggtcttcttattaccttcattgagctgattaaaaacccagcgtttaagttctggaaccatgaatttgtacactgtgccccagaaatcgaaaagtgagttcaaagtaatttttaattgtctaggaatgagactggagactgaaaaccatctgtctctaggttgggtcagctgaatgagatgcaaggtattgttaggcctactctttaatcagagatttgtaactgtcttcatccttcaggttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaacctttgtctggaacttcttggctttgtgcaagctgtgtccaaggcaagtacataaactggtaccttgtaatgaagaggcagctgatgccatgcacttgtctgagggcatagctccatgtcttctgacattcctggtgtcccaaagaatagcaaaaagccagtttgaatattatgtaacttatttttttaatgtggacaggggaccttgaaaatcactaagttattaaaaatgtggatgtgctagaattggatatgtccaggaacatgggaagggctcactattggaatcccatgagtttccattttgtctctacccaaacgtattccaaagctgactgcatttgtaccatcttatttcttttggggattatacacctcagccgcctgagatgggggtcagctctttatataaagggaaaccagaccaggcctaaagcccaccccctaccctcacccccacaatcctctcctgaaacttaaaaacagtgggaatataggaaagggaaccaaatctcattaattaattgttctcccccattaccccactgaatgaatggccatacaggctaagctgaataatgacaaagttgaaaggaccaatacagccccttttataaggattttgaatgttttgcaaatgtattggtccctgtgttgtattttgtagccttttcctgggcttcagctcccctacttcttgtatgtgtatgcatactgtagctaaccattaaagtcatgacacaca

SEQ ID NO: 355677 - DNA, 2752 bp, Homo sapiens
caggcgctgttggctgtctgcaagcttgtgcagtgagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccagtaggtggtcttggcacaggcagcctgactggtataggaactggtgctcttggactccctgcagtgaataacgacccttttgtacagaggaaactgggcacctctggactgaatcagcctacattccagcagacggacttgtctcaggtgtggccagaggcaaaccagcactttagtaaagagatagatgatgaagcaaacagctatttccagcgaatatataatcatccaccacatccaaccatgtctgttgatgaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagtgctcctgacctctgataaagctgcagccaatttctcagatcgttctttgctgaagaacttgggacattggctaggaatgatcacattagctaaaaacaaacccatcttacacactgacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctaaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtgtaagttggctatttccttggtataggtacaaaacgtattactgcttgtctgtaataatttttttctttgtctatatatggcactgggcgttaccacttattcttaataatcaccatatttgtttgatgtcttccatcattttagattgtaattctgtgaggcaaagcatcatgtctgtgtgtttttttttttttctgttatattctcaacccgatgtttgacagatagtagatacccaaatatttgttggtttaaataaattaagatttaaaaagga

SEQ ID NO: 355678 - DNA, 264 bp, Homo sapiens
cttgctgttttattcagaagactgcagtagaaaaagcaggccctgagatggacaagagattagcaactgtaagtgtttagaatttgccttttaagattttcttttttaatttagggaagtgccttataacaagaacctcagtgactttttttgtttgcaggaatttgagctgagaaaacatgctaggcaagaaggacgcagatactgtgatcctgttgttttaacatatcaagctgaacggatgccagagcaaatcaggctgaa

SEQ ID NO: 355679 - DNA, 551 bp, Homo sapiens
ggctcgttttaatctatttttaagtaaaatatagcctttaaaaatcagaggtagtgtattttctgatgtaaatcctgtgaaaatcataagtattttctccttctatttttgttttcttcactttgacattttcttcaaataagttattcataggtaagatggaaaaaaatgacctagattagcatttggacaaaaacattttgttagtgatgcttctgttctgacatgaaatgatggtagaataattttgttggcagattgaaggactatccccagtattgtcagcatttggcttctatcagtcactttatgcaatttccacatcatttacaggaggtaagtgccctctgtaactaaaacccaaatagctatgtagtatttggagggtttaatattttggcttttttttgtagacttgatagtaatggcattaagatttcttaatgattggcatgatataggtacacatatcttttgttgaggttgctcattttgtggccttacaagagaacatgaaaaaataatcattcttggattatcttttctaagta

SEQ ID NO: 355680 - DNA, 367 bp, Homo sapiens
tgaatctctaccattcagcagcagctggccgcgacagtaccaaagctttctctgcatttgttggacaggtagagcttttggaaagaaaggtgctttttattcaacataagtagggtgtgatgcctccaatattaaagctcagtattgcgtacatgtggtcagacagttacctccatactcatgcaaacccaaactgtcatcattatatggttaaattacagcctgttttctcatggttgatcactaagcagtaaaggcaacattccctcccaccgttggttctgtatattccatttcagttgtcacagctacaaagtacaatgggtcagataatgaataataaaactaccaaatgtatttttactag

SEQ ID NO: 355681 - DNA, 6179 bp, Homo sapiens
caggcgctgttggctgtctgcaagcttgtgcagtgagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccagtaggtggtcttggcacaggcagcctgactggtataggaactggtgctcttggactccctgcagtgaataacgacccttttgtacagaggaaactgggcacctctggactgaatcagcctacattccagcagacggacttgtctcaggtgtggccagaggcaaaccagcactttagtaaagagatagatgatgaagcaaacagctatttccagcgaatatataatcatccaccacatccaaccatgtctgttgatgaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagtgctcctgacctctgataaagctgcagccaatttctcagatcgttctttgctgaagaacttgggacattggctaggaatgatcacattagctaaaaacaaacccatcttacacactgacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctaaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtactgcttccccacaacaaagagaaatgatggatcaggcagctgctcaattagctcaggacaattgtgagttggcttgctgttttattcagaagactgcagtagaaaaagcaggccctgagatggacaagagattagcaactgaatttgagctgagaaaacatgctaggcaagaaggacgcagatactgtgatcctgttgttttaacatatcaagctgaacggatgccagagcaaatcaggctgaaagttggtggtgtggacccaaagcagttggctgtttacgaagagtttgcacgcaatgttcctggcttcttacctacaaatgacttaagtcagcccacgggatttttagcccagcccatgaagcaagcttgggcaacagatgatgtagctcagatttatgataagtgtattacagaactggagcaacatctacatgccatcccaccaactttggccatgaaccctcaagctcaggctcttcgaagtctcttggaggttgtagttttatctcgaaactctcgggatgccatagctgctcttggattgctccaaaaggctgtagagggcttactagatgccacaagtggtgctgatgctgaccttctgctgcgctacagggaatgccacctcttggtcctaaaagctctgcaggatggccgggcatatgggtctccatggtgcaacaaacagatcacaaggtgcctaattgaatgtcgagatgaatataaatataatgtggaggctgtggagctgctaattcgcaatcatttggttaatatgcagcagtatgatcttcacctagcgcagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaaggattgccccagctgatggaagtagtgcgatccaactatgaagcaatgattgatcgtgctcatggaggcccaaactttatgatgcattctgggatctctcaagcctcagagtatgatgaccctccaggcctgagggagaaggcagagtatcttctgagggaatgggtgaatctctaccattcagcagcagctggccgcgacagtaccaaagctttctctgcatttgttggacagatgcaccagcaaggaatactgaagaccgatgatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtggacatgttgagtgaaattaacattgctccccggattctcaccaatttcactggagtaatgccacctcagttcaaaaaggatttggattcctatcttaaaactcgatcaccagtcactttcctgtctgatctgcgcagcaacctacaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagctccggtacccaaatagccacactcactacttcagttgcaccatgctgtacctttttgcagaggccaatacggaagccatccaagaacagatcacaagagttctcttggaacggttgattgtaaataggccacatccttggggtcttcttattaccttcattgagctgattaaaaacccagcgtttaagttctggaaccatgaatttgtacactgtgccccagaaatcgaaaagttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaacctttgtctggaacttcttggctttgtgcaagctgtgtccaaggcaagtacataaactggtaccttgtaatgaagaggcagctgatgccatgcacttgtctgagggcatagctccatgtcttctgacattcctggtgtcccaaagaatagcaaaaagccagtttgaatattatgtaacttatttttttaatgtggacaggggaccttgaaaatcactaagttattaaaaatgtggatgtgctagaattggatatgtccaggaacatgggaagggctcactattggaatcccatgagtttccattttgtctctacccaaacgtattccaaagctgactgcatttgtaccatcttatttcttttggggattatacacctcagccgcctgagatgggggtcagctctttatataaagggaaaccagaccaggcctaaagcccaccccctaccctcacccccacaatcctctcctgaaacttaaaaacagtgggaatataggaaagggaaccaaatctcattaattaattgttctcccccattaccccactgaatgaatggccatacaggctaagctgaataatgacaaagttgaaaggaccaatacagccccttttataaggattttgaatgttttgcaaatgtattggtccctgtgttgtattttgtagccttttcctgggcttcagctcccctacttcttgtatgtgtatgcatactgtagctaaccattaaagtcatgacacaca

SEQ ID NO: 355682 - DNA, 5435 bp, Homo sapiens
caggcgctgttggctgtctgcaagcttgtgcagtgagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccagtaggtggtcttggcacaggcagcctgactggtataggaactggtgctcttggactccctgcagtgaataacgacccttttgtacagaggaaactgggcacctctggactgaatcagcctacattccagcagacggacttgtctcaggtgtggccagaggcaaaccagcactttagtaaagagatagatgatgaagcaaacagctatttccagcgaatatataatcatccaccacatccaaccatgtctgttgatgaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagtgctcctgacctctgataaagctgcagccaatttctcagatcgttctttgctgaagaacttgggacattggctaggaatgatcacattagctaaaaacaaacccatcttacacactgacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctaaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtactgcttccccacaacaaagagaaatgatggatcaggcagctgctcaattagctcaggacaattgtgagttggcttgctgttttattcagaagactgcagtagaaaaagcaggccctgagatggacaagagattagcaactgaatttgagctgagaaaacatgctaggcaagaaggacgcagatactgtgatcctgttgttttaacatatcaagctgaacggatgccagagcaaatcaggctgaaagttggtggtgtggacccaaagcagttggctgtttacgaagagtttgcacgcaatgttcctggcttcttacctacaaatgacttaagtcagcccacgggatttttagcccagcccatgaagcaagcttgggcaacagatgatgtagctcagatttatgataagtgtattacagaactggagcaacatctacatgccatcccaccaactttggccatgaaccctcaagctcaggctcttcgaagtctcttggaggttgtagttttatctcgaaactctcgggatgccatagctgctcttggattgctccaaaaggctgtagagggcttactagatgccacaagtggtgctgatgctgaccttctgctgcgctacagggaatgccacctcttggtcctaaaagctctgcaggatggccgggcatatgggtctccatggtgcaacaaacagatcacaaggtgcctaattgaatgtcgagatgaatataaatataatgtggaggctgtggagctgctaattcgcaatcatttggttaatatgcagcagtatgatcttcacctagcgcagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaaggattgccccagctgatggaagtagtgcgatccaactatgaagcaatgattgatcgtgctcatggaggcccaaactttatgatgcattctgggatctctcaagcctcagagtatgatgaccctccaggcctgagggagaaggcagagtatcttctgagggaatgggtgaatctctaccattcagcagcagctggccgcgacagtaccaaagctttctctgcatttgttggacagatgcaccagcaaggaatactgaagaccgatgatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtggacatgttgagtgaaattaacattgctccccggattctcaccaatttcactggagtaatgccacctcagttcaaaaaggatttggattcctatcttaaaactcgatcaccagtcactttcctgtctgatctgcgcagcaacctacaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagctccggtacccaaatagccacactcactacttcagttgcaccatgctgtacctttttgcagaggccaatacggaagccatccaagaacagatcacaagagttctcttggaacggttgattgtaaataggccacatccttggggtcttcttattaccttcattgagctgattaaaaacccagcgtttaagttctggaaccatgaatttgtacactgtgccccagaaatcgaaaagttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaac

SEQ ID NO: 355683 - DNA, 6261 bp, Homo sapiens
caggcgctgttggctgtctgcaagcttgtgcagtgagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccagtaggtggtcttggcacaggcagcctgactggtataggaactggtgctcttggactccctgcagtgaataacgacccttttgtacagaggaaactgggcacctctggactgaatcagcctacattccagcagacggacttgtctcaggtgtggccagaggcaaaccagcactttagtaaagagatagatgatgaagcaaacagctatttccagcgaatatataatcatccaccacatccaaccatgtctgttgatgaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagtgctcctgacctctgataaagctgcagccaatttctcagatcgttctttgctgaagaacttgggacattggctaggaatgatcacattagctaaaaacaaacccatcttacacactgacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctaaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtactgcttccccacaacaaagagaaatgatggatcaggcagctgctcaattagctcaggacaattgtgagttggcttgctgttttattcagaagactgcagtagaaaaagcaggccctgagatggacaagagattagcaactgaatttgagctgagaaaacatgctaggcaagaaggacgcagatactgtgatcctgttgttttaacatatcaagctgaacggatgccagagcaaatcaggctgaaagttggtggtgtggacccaaagcagttggctgtttacgaagagtttgcacgcaatgttcctggcttcttacctacaaatgacttaagtcagcccacgggatttttagcccagcccatgaagcaagcttgggcaacagatgatgtagctcagatttatgataagtgtattacagaactggagcaacatctacatgccatcccaccaactttggccatgaaccctcaagctcaggctcttcgaagtctcttggaggttgtagttttatctcgaaactctcgggatgccatagctgctcttggattgctccaaaaggctgtagagggcttactagatgccacaagtggtgctgatgctgaccttctgctgcgctacagggaatgccacctcttggtcctaaaagctctgcaggatggccgggcatatgggtctccatggtgcaacaaacagatcacaaggtgcctaattgaatgtcgagatgaatataaatataatgtggaggctgtggagctgctaattcgcaatcatttggttaatatgcagcagtatgatcttcacctagcgcagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaaggattgccccagctgatggaagtagtgcgatccaactatgaagcaatgattgatcgtgctcatggaggcccaaactttatgatgcattctgggatctctcaagcctcagagtatgatgaccctccaggcctgagggagaaggcagagtatcttctgagggaatgggtgaatctctaccattcagcagcagctggccgcgacagtaccaaagctttctctgcatttgttggacagatgcaccagcaaggaatactgaagaccgatgatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaagtactgcagaaagtaccattctttggcccctcagatcagaagaaatgtgactgctatgtaatggagtgaacttgacaaagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtggacatgttgagtgaaattaacattgctccccggattctcaccaatttcactggagtaatgccacctcagttcaaaaaggatttggattcctatcttaaaactcgatcaccagtcactttcctgtctgatctgcgcagcaacctacaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagctccggtacccaaatagccacactcactacttcagttgcaccatgctgtacctttttgcagaggccaatacggaagccatccaagaacagatcacaagagttctcttggaacggttgattgtaaataggccacatccttggggtcttcttattaccttcattgagctgattaaaaacccagcgtttaagttctggaaccatgaatttgtacactgtgccccagaaatcgaaaagttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaacctttgtctggaacttcttggctttgtgcaagctgtgtccaaggcaagtacataaactggtaccttgtaatgaagaggcagctgatgccatgcacttgtctgagggcatagctccatgtcttctgacattcctggtgtcccaaagaatagcaaaaagccagtttgaatattatgtaacttatttttttaatgtggacaggggaccttgaaaatcactaagttattaaaaatgtggatgtgctagaattggatatgtccaggaacatgggaagggctcactattggaatcccatgagtttccattttgtctctacccaaacgtattccaaagctgactgcatttgtaccatcttatttcttttggggattatacacctcagccgcctgagatgggggtcagctctttatataaagggaaaccagaccaggcctaaagcccaccccctaccctcacccccacaatcctctcctgaaacttaaaaacagtgggaatataggaaagggaaccaaatctcattaattaattgttctcccccattaccccactgaatgaatggccatacaggctaagctgaataatgacaaagttgaaaggaccaatacagccccttttataaggattttgaatgttttgcaaatgtattggtccctgtgttgtattttgtagccttttcctgggcttcagctcccctacttcttgtatgtgtatgcatactgtagctaaccattaaagtcatgacacaca

SEQ ID NO: 355684 - DNA, 6325 bp, Homo sapiens
caggcgctgttggctgtctgcaagcttgtgcagtgagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccagtaggtggtcttggcacaggcagcctgactggtataggaactggtgctcttggactccctgcagtgaataacgacccttttgtacagaggaaactgggcacctctggactgaatcagcctacattccagcagacggacttgtctcaggtgtggccagaggcaaaccagcactttagtaaagagatagatgatgaagcaaacagctatttccagcgaatatataatcatccaccacatccaaccatgtctgttgatgaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagtgctcctgacctctgataaagctgcagccaatttctcagatcgttctttgctgaagaacttgggacattggctaggaatgatcacattagctaaaaacaaacccatcttacacactgacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctaaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtactgcttccccacaacaaagagaaatgatggatcaggcagctgctcaattagctcaggacaattgtgagttggcttgctgttttattcagaagactgcagtagaaaaagcaggccctgagatggacaagagattagcaactgaatttgagctgagaaaacatgctaggcaagaaggacgcagatactgtgatcctgttgttttaacatatcaagctgaacggatgccagagcaaatcaggctgaaagttggtggtgtggacccaaagcagttggctgtttacgaagagtttgcacgcaatgttcctggcttcttacctacaaatgacttaagtcagcccacgggatttttagcccagcccatgaagcaagcttgggcaacagatgatgtagctcagatttatgataagtgtattacagaactggagcaacatctacatgccatcccaccaactttggccatgaaccctcaagctcaggctcttcgaagtctcttggaggttgtagttttatctcgaaactctcgggatgccatagctgctcttggattgctccaaaaggctgtagagggcttactagatgccacaagtggtgctgatgctgaccttctgctgcgctacagggaatgccacctcttggtcctaaaagctctgcaggatggccgggcatatgggtctccatggtgcaacaaacagatcacaaggtgcctaattgaatgtcgagatgaatataaatataatgtggaggctgtggagctgctaattcgcaatcatttggttaatatgcagcagtatgatcttcacctagcgcagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaaggattgccccagctgatggaagtagtgcgatccaactatgaagcaatgattgatcgtgctcatggaggcccaaactttatgatgcattctgggatctctcaagcctcagagtatgatgaccctccaggcctgagggagaaggcagagtatcttctgagggaatgggtgaatctctaccattcagcagcagctggccgcgacagtaccaaagctttctctgcatttgttggacagatgcaccagcaaggaatactgaagaccgatgatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtggacatgttgagtgaaattaacattgctccccggattctcaccaatttcactggagtaatgccacctcagttcaaaaaggatttggattcctatcttaaaactcgatcaccagtcactttcctgtctgatctgcgcagcaacctacaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagctccggtacccaaatagccacactcactacttcagttgcaccatgctgtacctttttgcagaggccaatacggaagccatccaagaacagatcacaagagttctcttggaacggttgattgtaaataggccacatccttggggtcttcttattaccttcattgagctgattaaaaacccagcgtttaagttctggaaccatgaatttgtacactgtgccccagaaatcgaaaagtgagttcaaagtaatttttaattgtctaggaatgagactggagactgaaaaccatctgtctctaggttgggtcagctgaatgagatgcaaggtattgttaggcctactctttaatcagagatttgtaactgtcttcatccttcaggttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaacctttgtctggaacttcttggctttgtgcaagctgtgtccaaggcaagtacataaactggtaccttgtaatgaagaggcagctgatgccatgcacttgtctgagggcatagctccatgtcttctgacattcctggtgtcccaaagaatagcaaaaagccagtttgaatattatgtaacttatttttttaatgtggacaggggaccttgaaaatcactaagttattaaaaatgtggatgtgctagaattggatatgtccaggaacatgggaagggctcactattggaatcccatgagtttccattttgtctctacccaaacgtattccaaagctgactgcatttgtaccatcttatttcttttggggattatacacctcagccgcctgagatgggggtcagctctttatataaagggaaaccagaccaggcctaaagcccaccccctaccctcacccccacaatcctctcctgaaacttaaaaacagtgggaatataggaaagggaaccaaatctcattaattaattgttctcccccattaccccactgaatgaatggccatacaggctaagctgaataatgacaaagttgaaaggaccaatacagccccttttataaggattttgaatgttttgcaaatgtattggtccctgtgttgtattttgtagccttttcctgggcttcagctcccctacttcttgtatgtgtatgcatactgtagctaaccattaaagtcatgacacaca

SEQ ID NO: 355685 - DNA, 5677 bp, Homo sapiens
caggcgctgttggctgtctgcaagcttgtgcagtgagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccagtaggtggtcttggcacaggcagcctgactggtataggaactggtgctcttggactccctgcagtgaataacgacccttttgtacagaggaaactgggcacctctggactgaatcagcctacattccagcagacggacttgtctcaggtgtggccagaggcaaaccagcactttagtaaagagatagatgatgaagcaaacagctatttccagcgaatatataatcatccaccacatccaaccatgtctgttgatgaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagtgctcctgacctctgataaagctgcagccaatttctcagatcgttctttgctgaagaacttgggacattggctaggaatgatcacattagctaaaaacaaacccatcttacacactgacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctaaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtactgcttccccacaacaaagagaaatgatggatcaggcagctgctcaattagctcaggacaattgtgagttggcttgctgttttattcagaagactgcagtagaaaaagcaggccctgagatggacaagagattagcaactgaatttgagctgagaaaacatgctaggcaagaaggacgcagatactgtgatcctgttgttttaacatatcaagctgaacggatgccagagcaaatcaggctgaaagttggtggtgtggacccaaagcagttggctgtttacgaagagtttgcacgcaatgttcctggcttcttacctacaaatgacttaagtcagcccacgggatttttagcccagcccatgaagcaagcttgggcaacagatgatgtagctcagatttatgataagtgtattacagaactggagcaacatctacatgccatcccaccaactttggccatgaaccctcaagctcaggctcttcgaagtctcttggaggttgtagttttatctcgaaactctcgggatgccatagctgctcttggattgctccaaaaggctgtagagggcttactagatgccacaagtggtgctgatgctgaccttctgctgcgctacagggaatgccacctcttggtcctaaaagctctgcaggatggccgggcatatgggtctccatggtgcaacaaacagatcacaaggtgcctaattgaatgtcgagatgaatataaatataatgtggaggctgtggagctgctaattcgcaatcatttggttaatatgcagcagtatgatcttcacctagcgcagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaaggattgccccagctgatggaagtagtgcgatccaactatgaagcaatgattgatcgtgctcatggaggcccaaactttatgatgcattctgggatctctcaagcctcagagtatgatgaccctccaggcctgagggagaaggcagagtatcttctgagggaatgggtgaatctctaccattcagcagcagctggccgcgacagtaccaaagctttctctgcatttgttggacagatgcaccagcaaggaatactgaagaccgatgatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtggacatgttgagtgaaattaacattgctccccggattctcaccaatttcactggagtaatgccacctcagttcaaaaaggatttggattcctatcttaaaactcgatcaccagtcactttcctgtctgatctgcgcagcaacctacaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagctccggtacccaaatagccacactcactacttcagttgcaccatgctgtacctttttgcagaggccaatacggaagccatccaagaacagatcacaagagttctcttggaacggttgattgtaaataggccacatccttggggtcttcttattaccttcattgagctgattaaaaacccagcgtttaagttctggaaccatgaatttgtacactgtgccccagaaatcgaaaagttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaacctttgtctggaacttcttggctttgtgcaagctgtgtccaaggcaagtacataaactggtaccttgtaatgaagaggcagctgatgccatgcacttgtctgagggcatagctccatgtcttctgacattcctggtgtcccaaagaatagcaaaaagccagtttgaatattatgtaacttatttttttaatgtggacaggggaccttgaaaatcactaagttattaaaaatgtggatgtgcta

SEQ ID NO: 355686 - DNA, 6125 bp, Homo sapiens
caggcgctgttggctgtctgcaagcttgtgcagtgagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccagtaggtggtcttggcacaggcagcctgactggtataggaactggtgctcttggactccctgcagtgaataacgacccttttgtacagaggaaactgggcacctctggactgaatcagcctacattccagcagacggacttgtctcaggtgtggccagaggcaaaccagcactttagtaaagagatagatgatgaagcaaacagctatttccagcgaatatataatcatccaccacatccaaccatgtctgttgatgaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagtgctcctgacctctgataaagctgcagccaatttctcagatcgttctttgctgaagaacttgggacattggctaggaatgatcacattagctaaaaacaaacccatcttacacactgacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctaaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtactgcttccccacaacaaagagaaatgatggatcaggcagctgctcaattagctcaggacaattgtgagttggcttgctgttttattcagaagactgcagtagaaaaagcaggccctgagatggacaagagattagcaactgaatttgagctgagaaaacatgctaggcaagaaggacgcagatactgtgatcctgttgttttaacatatcaagctgaacggatgccagagcaaatcaggctgaaagttggtggtgtggacccaaagcagttggctgtttacgaagagtttgcacgcaatgttcctggcttcttacctacaaatgacttaagtcagcccacgggatttttagcccagcccatgaagcaagcttgggcaacagatgatgtagctcagatttatgataagtgtattacagaactggagcaacatctacatgccatcccaccaactttggccatgaaccctcaagctcaggctcttcgaagtctcttggaggttgtagttttatctcgaaactctcgggatgccatagctgctcttggattgctccaaaaggctgtagagggcttactagatgccacaagtggtgctgatgctgaccttctgctgcgctacagggaatgccacctcttggtcctaaaagctctgcaggatggccgggcatatgggtctccatggtgcaacaaacagatcacaaggtgcctaattgaatgtcgagatgaatataaatataatgtggaggctgtggagctgctaattcgcaatcatttggttaatatgcagcagtatgatcttcacctagcgcagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaaggattgccccagctgatggaagtagtgcgatccaactatgaagcaatgattgatcgtgctcatggaggcccaaactttatgatgcattctgggatctctcaagcctcagagtatgatgaccctccaggcctgagggagaaggcagagtatcttctgagggaatgggtgaatctctaccattcagcagcagctggccgcgacagtaccaaagctttctctgcatttgttggacagatgcaccagcaaggaatactgaagaccgatgatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtggacatgttgagtgaaattaacattgctccccggattctcaccaatttcactggagtaatgccacctcagttcaaaaaggatttggattcctatgtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagctccggtacccaaatagccacactcactacttcagttgcaccatgctgtacctttttgcagaggccaatacggaagccatccaagaacagatcacaagagttctcttggaacggttgattgtaaataggccacatccttggggtcttcttattaccttcattgagctgattaaaaacccagcgtttaagttctggaaccatgaatttgtacactgtgccccagaaatcgaaaagttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaacctttgtctggaacttcttggctttgtgcaagctgtgtccaaggcaagtacataaactggtaccttgtaatgaagaggcagctgatgccatgcacttgtctgagggcatagctccatgtcttctgacattcctggtgtcccaaagaatagcaaaaagccagtttgaatattatgtaacttatttttttaatgtggacaggggaccttgaaaatcactaagttattaaaaatgtggatgtgctagaattggatatgtccaggaacatgggaagggctcactattggaatcccatgagtttccattttgtctctacccaaacgtattccaaagctgactgcatttgtaccatcttatttcttttggggattatacacctcagccgcctgagatgggggtcagctctttatataaagggaaaccagaccaggcctaaagcccaccccctaccctcacccccacaatcctctcctgaaacttaaaaacagtgggaatataggaaagggaaccaaatctcattaattaattgttctcccccattaccccactgaatgaatggccatacaggctaagctgaataatgacaaagttgaaaggaccaatacagccccttttataaggattttgaatgttttgcaaatgtattggtccctgtgttgtattttgtagccttttcctgggcttcagctcccctacttcttgtatgtgtatgcatactgtagctaaccattaaagtcatgacacaca

SEQ ID NO: 355687 - DNA, 5360 bp, Homo sapiens
caggcgctgttggctgtctgcaagcttgtgcagtgagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccagtaggtggtcttggcacaggcagcctgactggtataggaactggtgctcttggactccctgcagtgaataacgacccttttgtacagaggaaactgggcacctctggactgaatcagcctacattccagcagacggacttgtctcaggtgtggccagaggcaaaccagcactttagtaaagagatagatgatgaagcaaacagctatttccagcgaatatataatcatccaccacatccaaccatgtctgttgatgaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagtgctcctgacctctgataaagctgcagccaatttctcagatcgttctttgctgaagaacttgggacattggctaggaatgatcacattagctaaaaacaaacccatcttacacactgacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctaaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtactgcttccccacaacaaagagaaatgatggatcaggcagctgctcaattagctcaggacaattgtgagttggcttgctgttttattcagaagactgcagtagaaaaagcaggccctgagatggacaagagattagcaactgaatttgagctgagaaaacatgctaggcaagaaggacgcagatactgtgatcctgttgttttaacatatcaagctgaacggatgccagagcaaatcaggctgaaagttggtggtgtggacccaaagcagttggctgtttacgaagagtttgcacgcaatgttcctggcttcttacctacaaatgacttaagtcagcccacgggatttttagcccagcccatgaagcaagcttgggcaacagatgatgtagctcagatttatgataagtgtattacagaactggagcaacatctacatgccatcccaccaactttggccatgaaccctcaagctcaggctcttcgaagtctcttggaggttgtagttttatctcgaaactctcgggatgccatagctgctcttggattgctccaaaaggctgtagagggcttactagatgccacaagtggtgctgatgctgaccttctgctgcgctacagggaatgccacctcttggtcctaaaagctctgcaggatggccgggcatatgggtctccatggtgcaacaaacagatcacaaggtgcctaattgaatgtcgagatgaatataaatataatgtggaggctgtggagctgctaattcgcaatcatttggttaatatgcagcagtatgatcttcacctagcgcagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaaggattgccccagctgatggaagtagtgcgatccaactatgaagcaatgattgatcgtgctcatggaggcccaaactttatgatgcattctgggatctctcaagcctcagagtatgatgaccctccaggcctgagggagaaggcagagtatcttctgagggaatgggtgaatctctaccattcagcagcagctggccgcgacagtaccaaagctttctctgcatttgttggacagatgcaccagcaaggaatactgaagaccgatgatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtggacatgttgagtgaaattaacattgctccccggattctcaccaatttcactggagtaatgccacctcagttcaaaaaggatttggattcctatcttaaaactcgatcaccagtcactttcctgtctgatctgcgcagcaacctacaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagctccggtacccaaatagccacactcactacttcagttgcaccatgctgtacctttttgcagaggccaatacggaagccatccaagaacagatcacaagagttctcttggaacggttgattgtaaataggccacatccttggggtcttcttattaccttcattgagctgattaaaaacccagcgtttaagttctggaaccatgaatttgtacactgtgccccagaaatcgaaaagttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcgggctagtcgggggatcctcagagcacccacgtcg

SEQ ID NO: 355688 - DNA, 2181 bp, Homo sapiens
gggtgatgtcacttccatgattcattgtacgcgccgcaccgagagacggctctgtgagccattggtgagtactgacctggtcttgccatgcttgatgtcctcgcactcgagatatatagatctagtagagacctgctgatcatattaagggcttaaccacgagcatgagaagggcatggactattgttagtgccttcagcggatctcgtatggatcagagtatgcaagactagtggaagacgacgtttccattagcaatactgttggcaactcaccatacatctagtgtgacatgtcctctaacagatggcgcaactaataatggagtggcgtagcatggatatacttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtggacatgttgagtgaaattaacattgctccccggattctcaccaatttcactggagtaatgccacctcagttcaaaaaggatttggattcctatcttaaaactcgatcaccagtcactttcctgtctgatctgcgcagcaacctacaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagctccggtacccaaatagccacactcactacttcagttgcaccatgctgtacctttttgcagaggccaatacggaagccatccaagaacagatcacaagagttctcttggaacggttgattgtaaataggccacatccttggggtcttcttattaccttcattgagctgattaaaaacccagcgtttaagttctggaaccatgaatttgtacactgtgccccagaaatcgaaaagttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaacctttgtctggaacttcttggctttgtgcaagctgtgtccaaggcaagtacataaactggtaccttgtaatgaagaggcagctgatgccatgcacttgtctgagggcatagctccatgtcttctgacattcctggtgtcccaaagaatagcaaaaagccagtttgaatattatgtaacttatttttttaatgtggacaggggaccttgaaaatcactaagttattaaaaatgtggatgtgctagaattggatatgtccaggaacatgggaagggctcactattggaatcccatgagtttccattttgtctctacccaaacgtattccaaagctgactgcatttgtaccatcttatttcttttggggattatacacctcagccgcctgagatgggggtcagctctttatataaagggaaaccagaccaggcctaaagcccaccccctaccctcacccccacaatcctctcctgaaacttaaaaacagtgggaatataggaaagggaaccaaatctcattaattaattgttctcccccattaccccactgaatgaatggccatacaggctaagctgaataatgacaaagttgaaaggaccaatacagccccttttataaggattttgaatgttttgcaaatgtattggtccctgtgttgtattttgtagccttttcctgggcttcagctcccctacttcttgtatgtgtatgcatactgtagctaaccattaaagtcatgacacaca

SEQ ID NO: 355689 - DNA, 1704 bp, Homo sapiens
gttctgttttgctcattttaaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagctccggtacccaaatagccacactcactacttcagttgcaccatgctgtacctttttgcagaggccaatacggaagccatccaagaacagatcacaagagttctcttggaacggttgattgtaaataggccacatccttggggtcttcttattaccttcattgagctgattaaaaacccagcgtttaagttctggaaccatgaatttgtacactgtgccccagaaatcgaaaagtgagttcaaagtaatttttaattgtctaggaatgagactggagactgaaaaccatctgtctctaggttgggtcagctgaatgagatgcaaggtattgttaggcctactctttaatcagagatttgtaactgtcttcatccttcaggttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaacctttgtctggaacttcttggctttgtgcaagctgtgtccaaggcaagtacataaactggtaccttgtaatgaagaggcagctgatgccatgcacttgtctgagggcatagctccatgtcttctgacattcctggtgtcccaaagaatagcaaaaagccagtttgaatattatgtaacttatttttttaatgtggacaggggaccttgaaaatcactaagttattaaaaatgtggatgtgctagaattggatatgtccaggaacatgggaagggctcactattggaatcccatgagtttccattttgtctctacccaaacgtattccaaagctgactgcatttgtaccatcttatttcttttggggattatacacctcagccgcctgagatgggggtcagctctttatataaagggaaaccagaccaggcctaaagcccaccccctaccctcacccccacaatcctctcctgaaacttaaaaacagtgggaatataggaaagggaaccaaatctcattaattaattgttctcccccattaccccactgaatgaatggccatacaggctaagctgaataatgacaaagttgaaaggaccaatacagccccttttataaggattttgaatgttttgcaaatgtattggtccctgtgttgtattttgtagccttttcctgggcttcagctcccctacttcttgtatgtgtatgcatactgtagctaaccattaaagtcatgacacaca

SEQ ID NO: 355690 - DNA, 874 bp, Homo sapiens
cagcgatgtcagggaacaaaccagaggcagccatacttcatctattttcctcaaatcaagacagagaaggtatcattatcagcattcacaatatatatttggaaagacaaagggaaacaccggtgtttccctttgtctggaacttcttggctttgtgcaagctgtgtccaaggcaagtacataaactggtaccttgtaatgaagaggcagctgatgccatgcacttgtctgagggcatagctccatgtcttctgacattcctggtgtcccaaagaatagcaaaaagccagtttgaatattatgtaacttatttttttaatgtggacaggggaccttgaaaatcactaagttattaaaaatgtggatgtgctagaattggatatgtccaggaacatgggaagggctcactattggaatcccatgagtttccattttgtctctacccaaacgtattccaaagctgactgcatttgtaccatcttatttcttttggggattatacacctcagccgcctgagatgggggtcagctctttatataaagggaaaccagaccaggcctaaagcccaccccctaccctcacccccacaatcctctcctgaaacttaaaaacagtgggaatataggaaagggaaccaaatctcattaattaattgttctcccccattaccccactgaatgaatggccatacaggctaagctgaataatgacaaagttgaaaggaccaatacagccccttttataaggattttgaatgttttgcaaatgtattggtccctgtgttgtattttgtagccttttcctgggcttcagctcccctacttcttgtatgtgtatgcatactgtagctaaccattaaagtcatgacacaca

SEQ ID NO: 355691 - DNA, 4608 bp, Homo sapiens
caggcgctgttggctgtctgcaagcttgtgcagtgagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccagtaggtggtcttggcacaggcagcctgactggtataggaactggtgctcttggactccctgcagtgaataacgacccttttgtacagaggaaactgggcacctctggactgaatcagcctacattccagcagacggacttgtctcaggtgtggccagaggcaaaccagcactttagtaaagagatagatgatgaagcaaacagctatttccagcgaatatataatcatccaccacatccaaccatgtctgttgatgaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagtgctcctgacctctgataaagctgcagccaatttctcagatcgttctttgctgaagaacttgggacattggctaggaatgatcacattagctaaaaacaaacccatcttacacactgacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctaaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtactgcttccccacaacaaagagaaatgatggatcaggcagctgctcaattagctcaggacaattgtgagttggcttgctgttttattcagaagactgcagtagaaaaagcaggccctgagatggacaagagattagcaactgaatttgagctgagaaaacatgctaggcaagaaggacgcagatactgtgatcctgttgttttaacatatcaagctgaacggatgccagagcaaatcaggctgaaagttggtggtgtggacccaaagcagttggctgtttacgaagagtttgcacgcaatgttcctggcttcttacctacaaatgacttaagtcagcccacgggatttttagcccagcccatgaagcaagcttgggcaacagatgatgtagctcagatttatgataagtgtattacagaactggagcaacatctacatgccatcccaccaactttggccatgaaccctcaagctcaggctcttcgaagtctcttggaggttgtagttttatctcgaaactctcgggatgccatagctgctcttggattgctccaaaaggctgtagagggcttactagatgccacaagtggtgctgatgctgaccttctgctgcgctacagggaatgccacctcttggtcctaaaagctctgcaggatggccgggcatatgggtctccatggtgcaacaaacagatcacaaggtgcctaattgaatgtcgagatgaatataaatataatgtggaggctgtggagctgctaattcgcaatcatttggttaatatgcagcagtatgatcttcacctagcgcagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaaggattgccccagctgatggaagtagtgcgatccaactatgaagcaatgattgatcgtgctcatggaggcccaaactttatgatgcattctgggatctctcaagcctcagagtatgatgaccctccaggcctgagggagaaggcagagtatcttctgagggaatgggtgaatctctaccattcagcagcagctggccgcgacagtaccaaagctttctctgcatttgttggacaggtagagcttttggaaagaaagatgcaccagcaaggaatactgaagaccgatgatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgaccatgatcgagtcagtgacgagagaaaaaagttcgagtcagcataggaaagaaccacaaagaaggccattacaatcacgatcagtgaaacagaaaatgagacccaaatcagtagat

SEQ ID NO: 355692 - DNA, 563 bp, Homo sapiens
ggccgtaacgcgccgcgcggagccgacgagacggcggggctagagaggccgtcccgaccgcgccccccgccggaagcggcttgttcgggcctgagctggcgctacgaagttccggtccaggtctctgacttcgggcttgttcgctggtggcgtcggagccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttttttttgtggtcccaaa

SEQ ID NO: 355693 - DNA, 430 bp, Homo sapiens
gccgcagtgtgcctggattcctgggccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttttttttgtggtcccaaa

SEQ ID NO: 355694 - DNA, 472 bp, Homo sapiens
cgtggctggcccgtggggcgaggacgggttcttgcgagggcgaggagtgcgccagcccgcagctcagcccctctcttctccgcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttttttttgtggtcccaaa

SEQ ID NO: 355695 - DNA, 829 bp, Homo sapiens
ggccgtaacgcgccgcgcggagccgacgagacggcggggctagagaggccgtcccgaccgcgccccccgccggaagcggcttgttcgggcctgagctggcgctacgaagttccggtccaggtctctgacttcgggcttgttcgctggtggcgtcggagccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttttttttgtggtcccaaaaaaaaaaaaaagttgaagccctggcgcccgctgtggccctatggatgatatgctaactaaaccttaggcatgccgccttattttggggtccctccctggactcgccctttgggaggttggagacaatttatcggccggccttatccaacgcatattgggccaaacccccgtagtgcgccagttaatcatcttgccgcgaatgcctattaagcagtttggggataacccaagggggccgcacccattttcttttcacaactgccctt

SEQ ID NO: 355696 - DNA, 884 bp, Homo sapiens
  misc_feature (617)..(618): n is a, c, g, or t
ggccgtaacgcgccgcgcggagccgacgagacggcggggctagagaggccgtcccgaccgcgccccccgccggaagcggcttgttcgggcctgagctggcgctacgaagttccggtccaggtctctgacttcgggcttgttcgctggtggcgtcggagccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttttttttgtggtcccaaaaaaaaaaaaaaaaaaaaaaaaaaaaaaacaatttttgggcggcttgggccctcnnaaaagttttcataaaccactgtcgttgtggcccgggggcccagatgggctacggtgacccctgtgtcccaaaggtgggttccccagagaaaaacccggggaccaaggacagcagcggccgcggattcctccggcaatagaaaaaacgcccgccgggggaaaacgcggcacggtctctcgaacgcaatcccagaagggggctgcagagagggacagagagggagctgcaaccaccggggagtcccagaggaagcgccaaatcaatgc

SEQ ID NO: 355697 - DNA, 481 bp, Homo sapiens
gtcaacaatcccaagaagcaggaatgaaagtggcgctttctccgccccagggttccaggacatagtctgaggcaagatggagggtatgaggggccttcacacttcacttcatcccttctacccatcacaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttttttttgtggtcccaaa

SEQ ID NO: 355698 - DNA, 852 bp, Homo sapiens
  misc_feature (582)..(582): n is a, c, g, or t
  misc_feature (584)..(584): n is a, c, g, or t
  misc_feature (598)..(599): n is a, c, g, or t
  misc_feature (603)..(603): n is a, c, g, or t
  misc_feature (605)..(605): n is a, c, g, or t
  misc_feature (619)..(619): n is a, c, g, or t
  misc_feature (630)..(630): n is a, c, g, or t
  misc_feature (633)..(633): n is a, c, g, or t
  misc_feature (637)..(637): n is a, c, g, or t
  misc_feature (641)..(641): n is a, c, g, or t
  misc_feature (646)..(646): n is a, c, g, or t
  misc_feature (650)..(650): n is a, c, g, or t
  misc_feature (653)..(653): n is a, c, g, or t
  misc_feature (660)..(660): n is a, c, g, or t
  misc_feature (663)..(663): n is a, c, g, or t
  misc_feature (668)..(668): n is a, c, g, or t
  misc_feature (679)..(680): n is a, c, g, or t
  misc_feature (687)..(689): n is a, c, g, or t
  misc_feature (692)..(694): n is a, c, g, or t
  misc_feature (698)..(698): n is a, c, g, or t
ggccgtaacgcgccgcgcggagccgacgagacggcggggctagagaggccgtcccgaccgcgccccccgccggaagcggcttgttcgggcctgagctggcgctacgaagttccggtccaggtctctgacttcgggcttgttcgctggtggcgtcggagccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttttttttgtggtcccaaaaaaaaaaaaaaaaaaaaancntgcggccgaatttnnagtnantgggccaattcccntatagggagtngtntacnattnattgnccgnggnttaacancgngggantgggccctggnnttcccannnttnnncggnttgaagccaatcccccctttcccagttgcctgaatagccaaaaaggccgacccaatccgccttccaataagtggccccctctaatggaaatggaaatttaaacgttaaattttgtaaaaatcccgtatttgggcagctaattttaacctgggcc

SEQ ID NO: 355699 - DNA, 903 bp, Homo sapiens
  misc_feature (633)..(633): n is a, c, g, or t
  misc_feature (635)..(635): n is a, c, g, or t
  misc_feature (649)..(650): n is a, c, g, or t
  misc_feature (654)..(654): n is a, c, g, or t
  misc_feature (656)..(656): n is a, c, g, or t
  misc_feature (670)..(670): n is a, c, g, or t
  misc_feature (681)..(681): n is a, c, g, or t
  misc_feature (684)..(684): n is a, c, g, or t
  misc_feature (688)..(688): n is a, c, g, or t
  misc_feature (692)..(692): n is a, c, g, or t
  misc_feature (697)..(697): n is a, c, g, or t
  misc_feature (701)..(701): n is a, c, g, or t
  misc_feature (704)..(704): n is a, c, g, or t
  misc_feature (711)..(711): n is a, c, g, or t
  misc_feature (714)..(714): n is a, c, g, or t
  misc_feature (719)..(719): n is a, c, g, or t
  misc_feature (730)..(731): n is a, c, g, or t
  misc_feature (738)..(740): n is a, c, g, or t
  misc_feature (743)..(745): n is a, c, g, or t
  misc_feature (749)..(749): n is a, c, g, or t
ggccgtaacgcgccgcgcggagccgacgagacggcggggctagagaggccgtcccgaccgcgccccccgccggaagcggcttgttcgggcctgagctggcgctacgaagttccggtccaggtctctgacttcgggcttgttcgctggtggcgtcggagccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttttttttgtggtcccaaaaaaaaaaaaaaaaaaaaaaaaaaaaaaaaaaaaaaaaaaaaaaaaaaacaaaaaaaaaaaaaaaaaaaancntgcggccgaatttnnagtnantgggccaattcccntatagggagtngtntacnattnattgnccgnggnttaacancgngggantgggccctggnnttcccannnttnnncggnttgaagccaatcccccctttcccagttgcctgaatagccaaaaaggccgacccaatccgccttccaataagtggccccctctaatggaaatggaaatttaaacgttaaattttgtaaaaatcccgtatttgggcagctaattttaacctgggcc

SEQ ID NO: 355700 - DNA, 604 bp, Homo sapiens
ggccgtaacgcgccgcgcggagccgacgagacggcggggctagagaggccgtcccgaccgcgccccccgccggaagcggcttgttcgggcctgagctggcgctacgaagttccggtccaggtctctgacttcgggcttgttcgctggtggcgtcggagccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttttttttgtggtcccaaaaaaaaaaaatcagactgcggccgcttcgagctccttggccc

SEQ ID NO: 355701 - DNA, 584 bp, Homo sapiens
ggccgtaacgcgccgcgcggagccgacgagacggcggggctagagaggccgtcccgaccgcgccccccgccggaagcggcttgttcgggcctgagctggcgctacgaagttccggtccaggtctctgacttcgggcttgttcgctggtggcgtcggagccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccaggtctttccccctcttttctagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttttttttgtggtcccaaa

SEQ ID NO: 355702 - DNA, 2287 bp, Homo sapiens
ggagggcggcgctcggggcgggaggcccggccgggtccgctaggacagcggggccgctgggaagttgtgagagcggcgctcgggggcgcgcttgcgtgcacgagggcccgggccgcgagcagccgcggccgtcccggtcgccacccttagcagcggtcgcggtcggtgccgaagcggtgttccccgccttagccgctggcgcctcccaagagagcggccggtgggccctcgtcctgtcagtggcgtcggaggccggcgctgcggtggccgcgcccttctggtgctcggacaccgctgaggagccggggccgggcacggctggctgacggctccgggcagctaaggctgcccgaggagaaggcggcggccgcggcgtaggcgcacgtccggcgggctcctggagcctggaggaggccgaggggaccatgtccgggaggcgcttccacctctccaccaccgaccgcgtcatcaaagctgtcccctttcctccaacccaacggcttactttcaaggaagtatttgagaatgggaaacctaaagttgatgttttaaaaaaccatttggtaaaggaaggacgactggaagaggaagtagccttaaagataatcaatgatggggctgccatcctgaggcaagagaagactatgatagaagtagatgctccaatcacagtatgtggtgatattcatggacaattctttgacctaatgaagttatttgaagttggaggatcacctagtaacacacgctacctctttctgggtgactatgtggacagaggctatttcagtatagagtgtgtgctgtatttatggagtttaaagattaatcatcccaaaacattgtttctgcttcggggaaatcatgaatgcaggcatcttacagactatttcaccttcaaacaggaatgtcgaatcaaatattcggaacaggtgtatgatgcctgtatggagacatttgactgtcttcctcttgctgccctcttaaaccagcagtttctctgtgtacatggaggaatgtcacctgaaattacttctttagatgacattaggaaattagacaggtttacggaacctcccgcctttggacctgtgtgtgacctgctttggtctgatccctcagaggattatggcaatgagaagaccttggagcactatacccacaacactgtccgagggtgctcttatttctacagttaccctgcagtttgtgaatttttgcagaacaataatttactatcaattatcagagcccatgaagcccaagatgctgggtatcgaatgtacaggaagagccaagccacaggctttccatcacttattacaattttctctgcccccaattacctagatgtctataacaataaagctgctgtgttgaaatatgaaaacaatgtcatgaatatcaggcagtttaactgttctccacacccctactggcttccaaactttatggatgttttcacatggtctttgccttttgttggggaaaaagtcacagagatgctggtaaatgtgctcaacatatgctctgatgacgaactgatttctgatgatgaagcagaaggaagcactacagttcgtaaggagatcatcaggaataagatcagagccattgggaagatggcacgggtcttttcaattcttcggcaagaaagtgagagtgtgctgactctcaagggcctgactcccacaggcacactccctctgggcgtcctctcaggaggcaagcagactatcgagacagccatcagagggttctcgcttcagcacaagatccggagttttgaagaagcgcgaggtctggaccgaattaatgagcgaatgccaccccgaaaggatagcatacacgctggtgggccaatgaaatctgtaacctcagcacactcacatgctgcgcacaggagcgaccaagggaagaaagcccattcatgacttagagtcctgccgtggctcaggtggatctaaaactcaagaacaaattctatttatttattattggaaaatgaaaagcaactcaaaacaacttcaacctggaggtgcatttataattcagtctgcatttattctgtaaaaaggtgactgttttataaattcttttaatttatgttcaatatatataaaaagtgcatctgttttgtttttcccttttttctccataattttaagaaatgaatctgattgttgtcaacacatttgtgaagtcttgtgctataaaggggaacttcccctaataaaagggccttggaaacctcaaacctgggtttctgacttgaaaaaaatcagtc

SEQ ID NO: 355703 - DNA, 2287 bp, Homo sapiens
ggagggcggcgctcggggcgggaggcccggccgggtccgctaggacagcggggccgctgggaagttgtgagagcggcgctcgggggcgcgcttgcgtgcacgagggcccgggccgcgagcagccgcggccgtcccggtcgccacccttagcagcggtcgcggtcggtgccgaagcggtgttccccgccttagccgctggcgcctcccaagagagcggccggtgggccctcgtcctgtcagtggcgtcggaggccggcgctgcggtggccgcgcccttctggtgctcggacaccgctgaggagccggggccgggcacggctggctgacggctccgggcagctaaggctgcccgaggagaaggcggcggccgcggcgtaggcgcacgtccggcgggctcctggagcctggaggaggccgaggggaccatgtccgggaggcgcttccacctctccaccaccgaccgcgtcatcaaagctgtcccctttcctccaacccaacggcttactttcaaggaagtatttgagaatgggaaacctaaagttgatgttttaaaaaaccatttggtaaaggaaggacgactggaagaggaagtagccttaaagataatcaatgatggggctgccatcctgaggcaagagaagactatgatagaagtagatgctccaatcacagtatgtggtgatattcatggacaattctttgacctaatgaagttatttgaagttggaggatcacctagtaacacacgctacctctttctgggtgactatgtggacagaggctatttcagtatagagtgtgtgctgtatttatggagtttaaagattaatcatcccaaaacattgtttctgcttcggggaaatcatgaatgcaggcatcttacagactatttcaccttcaaacaggaatgtcgaatcaaatattcggaacaggtgtatgatgcctgtatggagacatttgactgtcttcctcttgctgccctcttaaaccagcagtttctctgtgtacatggaggaatgtcacctgaaattacttctttagatgacattaggaaattagacaggtttacggaacctcccgcctttggacctgtgtgtgacctgctttggtctgatccctcagaggattatggcaatgagaagaccttggagcactatacccacaacactgtccgagggtgctcttatttctacagttaccctgcagtttgtgaatttttgcagaacaataatttactatcaattatcagagcccatgaagcccaagatgctgggtatcgaatgtacaggaagagccaagccacaggctttccatcacttattacaattttctctgcccccaattacctagatgtctataacaataaagctgctgtgttgaaatatgaaaacaatgtcatgaatatcaggcagtttaactgttctccacacccctactggcttccaaactttatggatgttttcacatggtctttgccttttgttggggaaaaagtcacagagatgctggtaaatgtgctcaacatatgctctgatgacgaactgatttctgatgatgaagcagaaggaagcactacagttcgtaaggagatcatcaggaataagatcagagccattgggaagatggcacgggtcttttcaattcttcggcaagaaagtgagagtgtgctgactctcaagggcctgactcccacaggcacactccctctgggcgtcctctcaggaggcaagcagactatcgagacagccacagtagaagcggtagaggcccgggaagccatcagagggttctcgcttcagcacaagatccggagttttgaagaagcgcgaggtctggaccgaattaatgagcgaatgccaccccgaaaggatagcatacacgctggtgggccaatgaaatctgtaacctcagcacactcacatgctgcgcacaggagcgaccaagggaagaaagcccattcatgacttagagtcctgccgtggctcaggtggatctaaaactcaagaacaaattctatttatttattattggaaaatgaaaagcaactcaaaacaacttcaacctggaggtgcatttataattcagtctgcatttattctgtaaaaaggtgactgttttataaattcttttaatttatgttcaatatatataaaaagtgcatctgttttgtttttcccttttttctccataattttaagaaatgaatctgattgttgtcaacacatttgtgaagtcttgtgctataaaggggaacttcccctaataaaagggccttggaaacctcaaa

SEQ ID NO: 355704 - DNA, 993 bp, Homo sapiens
ggagggcggcgctcggggcgggaggcccggccgggtccgctaggacagcggggccgctgggaagttgtgagagcggcgctcgggggcgcgcttgcgtgcacgagggcccgggccgcgagcagccgcggccgtcccggtcgccacccttagcagcggtcgcggtcggtgccgaagcggtgttccccgccttagccgctggcgcctcccaagagagcggccggtgggccctcgtcctgtcagtggcgtcggaggccggcgctgcggtggccgcgcccttctggtgctcggacaccgctgaggagccggggccgggcacggctggctgacggctccgggcagctaaggctgcccgaggagaaggcggcggccgcggcgtaggcgcacgtccggcgggctcctggagcctggaggaggccgaggggaccatgtccgggaggcgcttccacctctccaccaccgaccgcgtcatcaaagctgtcccctttcctccaacccaacggcttactttcaaggaagtatttgagaatgggaaacctaaagttgatgttttaaaaaaccatttggtaaaggaaggacgactggaagaggaagtagccttaaagataatcaatgatggggctgccatcctgaggcaagagaagactatgatagaagtagatgctccaatcacagtatgtggtgatattcatggacaattctttgacctaatgaagttatttgaagttggaggatcacctagtaacacacgctacctctttctgggtgactatgtggacagaggctatttcagtatagagagatggggtcctgccatgttgcctaggctggagtgcagtggctatacacaggtgcgatcatttcgtacctcagcctccaactcctggattcaagccatcctcctgcctcagcttcctgagtatatggaactatagatgcacaccactgtgcctggctagtcattgtatttaataaaacaacttttaaaatatttat

SEQ ID NO: 355705 - DNA, 669 bp, Homo sapiens
actggtttttcgaagctttatcaacatttcaaatattttattattgcatcaccagaactataacagtgagaaaaggtatagttgtttctaggcatgttaacgaagcaggtgtttcctttgtgtcctatctttgcattaattttaaataaccttcaccacagctacagttttttttctgggctctatcagctttaatgcaacggcagaagcttaagcaactggtcatgagaggtcaagtggtttacttctgtatcccttccatgtacaagagacatccatttgattctcaagagagccaaataggtcagcctcttcagcgattctaaaagatttcaagagcagaggcagaagtagactggaatttagttcaattcatttctgaggttgccctaaggtaggcaagttaaattaactttgtttctatggaaaaccattgggaactgataaacttgtattatacttgtaattgttttattaggtaagatggttcaaaatgcgaatgccttaacttggtgttataaaagttgaatcggaaggaaaatatgtagaagctatttttaagtttttaacttatgtacagctcctggttgtgcaagatagaaagctgtcctaaacgaaaagattagctcttttgttacttttttttgtggtctatgtggcctttgtgcg

SEQ ID NO: 355706 - DNA, 655 bp, Homo sapiens
taaaaacttcatatttctgtaactattttgttgtttataaagtatgactataaattaataggactttgaaaataaacatgccagaacaaacatatccaaatgagtattgtcccttcaaagtagttaccttgggaggctacacacctattccaacaatgctgtccttgttcaaaaacatttttggaactcctcttttggcattgccttcagagtctgcgacacattcttttgattatcctcaatgatgggaaatcttcgtcctttgagggtggatttgatttttggacagccaaaagtcattcggagtcaagactgataaataagctgctgtgttgaaatatgaaaacaatgtcatgaatatcaggcagtttaactgttctccacacccctactggcttccaaactttatggatgttttcacatggtctttgccttttgttggggaaaaaggtaagagaactaaagcacatgtctcatcagttgtttggtgactgagcataccttatatttgcatgagcccctccatgattcagaaatgttttctaattttgtttgttctctacatagattttttttttttttttctgagatggagtctcgctctgtcacccaggctggagtgcagtggcacgatctcagctaactacaacctccg

SEQ ID NO: 355707 - DNA, 2257 bp, Homo sapiens
ggagggcggcgctcggggcgggaggcccggccgggtccgctaggacagcggggccgctgggaagttgtgagagcggcgctcgggggcgcgcttgcgtgcacgagggcccgggccgcgagcagccgcggccgtcccggtcgccacccttagcagcggtcgcggtcggtgccgaagcggtgttccccgccttagccgctggcgcctcccaagagagcggccggtgggccctcgtcctgtcagtggcgtcggaggccggcgctgcggtggccgcgcccttctggtgctcggacaccgctgaggagccggggccgggcacggctggctgacggctccgggcagctaaggctgcccgaggagaaggcggcggccgcggcgtaggcgcacgtccggcgggctcctggagcctggaggaggccgaggggaccatgtccgggaggcgcttccacctctccaccaccgaccgcgtcatcaaagctgtcccctttcctccaacccaacggcttactttcaaggaagtatttgagaatgggaaacctaaagttgatgttttaaaaaaccatttggtaaaggaaggacgactggaagaggaagtagccttaaagataatcaatgatggggctgccatcctgaggcaagagaagactatgatagaagtagatgctccaatcacagtatgtggtgatattcatggacaattctttgacctaatgaagttatttgaagttggaggatcacctagtaacacacgctacctctttctgggtgactatgtggacagaggctatttcagtatagagtgtgtgctgtatttatggagtttaaagattaatcatcccaaaacattgtttctgcttcggggaaatcatgaatgcaggcatcttacagactatttcaccttcaaacaggaatgtcgaatcaaatattcggaacaggtgtatgatgcctgtatggagacatttgactgtcttcctcttgctgccctcttaaaccagcagtttctctgtgtacatggaggaatgtcacctgaaattacttctttagatgacattaggaaattagacaggtttacggaacctcccgcctttggacctgtgtgtgacctgctttggtctgatccctcagaggattatggcaatgagaagaccttggagcactatacccacaacactgtccgagggtgctcttatttctacagttaccctgcagtttgtgaatttttgcagaacaataatttactatcaattatcagagcccatgaagcccaagatgctgggtatcgaatgtacaggaagagccaagccacaggctttccatcacttattacaattttctctgcccccaattacctagatgtctataacaataaagctgctgtgttgaaatatgaaaacaatgtcatgaatatcaggcagtttaactgttctccacacccctactggcttccaaactttatggatgttttcacatggtctttgccttttgttggggaaaaagtcacagagatgctggtaaatgtgctcaacatatgctctgatgacgaactgatttctgatgatgaagcagaaggaagcactacagttcgtaaggagatcatcaggaataagatcagagccattgggaagatggcacgggtcttttcaattcttcggcaagaaagtgagagtgtgctgactctcaagggcctgactcccacaggcacactccctctgggcgtcctctcaggaggcaagcagactatcgagacagccatcagagggttctcgcttcagcacaagatccggagttttgaagaagcgcgaggtctggaccgaattaatgagcgaatgccaccccgaaaggatagcatacacgctggtgggccaatgaaatctgtaacctcagcacactcacatgctgcgcacaggagcgaccaagggaagaaagcccattcatgacttagagtcctgccgtggctcaggtggatctaaaactcaagaacaaattctatttatttattattggaaaatgaaaagcaactcaaaacaacttcaacctggaggtgcatttataattcagtctgcatttattctgtaaaaaggtgactgttttataaattcttttaatttatgttcaatatatataaaaagtgcatctgttttgtttttcccttttttctccataattttaagaaatgaatctgattgttgtcaacacatttgtgaagtcttgtgctataaaggggaacttcccctaataaaagggccttggaaacctcaaa

SEQ ID NO: 355708 - DNA, 2314 bp, Homo sapiens
ggagggcggcgctcggggcgggaggcccggccgggtccgctaggacagcggggccgctgggaagttgtgagagcggcgctcgggggcgcgcttgcgtgcacgagggcccgggccgcgagcagccgcggccgtcccggtcgccacccttagcagcggtcgcggtcggtgccgaagcggtgttccccgccttagccgctggcgcctcccaagagagcggccggtgggccctcgtcctgtcagtggcgtcggaggccggcgctgcggtggccgcgcccttctggtgctcggacaccgctgaggagccggggccgggcacggctggctgacggctccgggcagctaaggctgcccgaggagaaggcggcggccgcggcgtaggcgcacgtccggcgggctcctggagcctggaggaggccgaggggaccatgtccgggaggcgcttccacctctccaccaccgaccgcgtcatcaaagctgtcccctttcctccaacccaacggcttactttcaaggaagtatttgagaatgggaaacctaaagttgatgttttaaaaaaccatttggtaaaggaaggacgactggaagaggaagtagccttaaagataatcaatgatggggctgccatcctgaggcaagagaagactatgatagaagtagatgctccaatcacagtatgtggtgatattcatggacaattctttgacctaatgaagttatttgaagttggaggatcacctagtaacacacgctacctctttctgggtgactatgtggacagaggctatttcagtatagagtgtgtgctgtatttatggagtttaaagattaatcatcccaaaacattgtttctgcttcggggaaatcatgaatgcaggcatcttacagactatttcaccttcaaacaggaatgtcgaatcaaatattcggaacaggtgtatgatgcctgtatggagacatttgactgtcttcctcttgctgccctcttaaaccagcagtttctctgtgtacatggaggaatgtcacctgaaattacttctttagatgacattaggaaattagacaggtttacggaacctcccgcctttggacctgtgtgtgacctgctttggtctgatccctcagaggattatggcaatgagaagaccttggagcactatacccacaacactgtccgagggtgctcttatttctacagttaccctgcagtttgtgaatttttgcagaacaataatttactatcaattatcagagcccatgaagcccaagatgctgggtatcgaatgtacaggaagagccaagccacaggctttccatcacttattacaattttctctgcccccaattacctagatgtctataacaataaagctgctgtgttgaaatatgaaaacaatgtcatgaatatcaggcagtttaactgttctccacacccctactggcttccaaactttatggatgttttcacatggtctttgccttttgttggggaaaaagtcacagagatgctggtaaatgtgctcaacatatgctctgatgacgaactgatttctgatgatgaagcagaagatcactacattccaagctatcagaaaggaagcactacagttcgtaaggagatcatcaggaataagatcagagccattgggaagatggcacgggtcttttcaattcttcggcaagaaagtgagagtgtgctgactctcaagggcctgactcccacaggcacactccctctgggcgtcctctcaggaggcaagcagactatcgagacagccacagtagaagcggtagaggcccgggaagccatcagagggttctcgcttcagcacaagatccggagttttgaagaagcgcgaggtctggaccgaattaatgagcgaatgccaccccgaaaggatagcatacacgctggtgggccaatgaaatctgtaacctcagcacactcacatgctgcgcacaggagcgaccaagggaagaaagcccattcatgacttagagtcctgccgtggctcaggtggatctaaaactcaagaacaaattctatttatttattattggaaaatgaaaagcaactcaaaacaacttcaacctggaggtgcatttataattcagtctgcatttattctgtaaaaaggtgactgttttataaattcttttaatttatgttcaatatatataaaaagtgcatctgttttgtttttcccttttttctccataattttaagaaatgaatctgattgttgtcaacacatttgtgaagtcttgtgctataaaggggaacttcccctaataaaagggccttggaaacctcaaa

SEQ ID NO: 355709 - DNA, 2317 bp, Homo sapiens
ggagggcggcgctcggggcgggaggcccggccgggtccgctaggacagcggggccgctgggaagttgtgagagcggcgctcgggggcgcgcttgcgtgcacgagggcccgggccgcgagcagccgcggccgtcccggtcgccacccttagcagcggtcgcggtcggtgccgaagcggtgttccccgccttagccgctggcgcctcccaagagagcggccggtgggccctcgtcctgtcagtggcgtcggaggccggcgctgcggtggccgcgcccttctggtgctcggacaccgctgaggagccggggccgggcacggctggctgacggctccgggcagctaaggctgcccgaggagaaggcggcggccgcggcgtaggcgcacgtccggcgggctcctggagcctggaggaggccgaggggaccatgtccgggaggcgcttccacctctccaccaccgaccgcgtcatcaaagctgtcccctttcctccaacccaacggcttactttcaaggaagtatttgagaatgggaaacctaaagttgatgttttaaaaaaccatttggtaaaggaaggacgactggaagaggaagtagccttaaagataatcaatgatggggctgccatcctgaggcaagagaagactatgatagaagtagatgctccaatcacagtatgtggtgatattcatggacaattctttgacctaatgaagttatttgaagttggaggatcacctagtaacacacgctacctctttctgggtgactatgtggacagaggctatttcagtatagagtgtgtgctgtatttatggagtttaaagattaatcatcccaaaacattgtttctgcttcggggaaatcatgaatgcaggcatcttacagactatttcaccttcaaacaggaatgtcgaatcaaatattcggaacaggtgtatgatgcctgtatggagacatttgactgtcttcctcttgctgccctcttaaaccagcagtttctctgtgtacatggaggaatgtcacctgaaattacttctttagatgacattaggaaattagacaggtttacggaacctcccgcctttggacctgtgtgtgacctgctttggtctgatccctcagaggattatggcaatgagaagaccttggagcactatacccacaacactgtccgagggtgctcttatttctacagttaccctgcagtttgtgaatttttgcagaacaataatttactatcaattatcagagcccatgaagcccaagatgctgggtatcgaatgtacaggaagagccaagccacaggctttccatcacttattacaattttctctgcccccaattacctagatgtctataacaataaagctgctgtgttgaaatatgaaaacaatgtcatgaatatcaggcagtttaactgttctccacacccctactggcttccaaactttatggatgttttcacatggtctttgccttttgttggggaaaaagtcacagagatgctggtaaatgtgctcaacatatgctctgatgacgaactgatttctgatgatgaagcagaaggaagcactacagttcgtaaggagatcatcaggaataagatcagagccattgggaagatggcacgggtcttttcaattcttcggcaagaaagtgagagtgtgctgactctcaagggcctgactcccacaggcacactccctctgggcgtcctctcaggaggcaagcagactatcgagacagccacagtagaagcggtagaggcccgggaagccatcagagggttctcgcttcagcacaagatccggagttttgaagaagcgcgaggtctggaccgaattaatgagcgaatgccaccccgaaaggatagcatacacgctggtgggccaatgaaatctgtaacctcagcacactcacatgctgcgcacaggagcgaccaagggaagaaagcccattcatgacttagagtcctgccgtggctcaggtggatctaaaactcaagaacaaattctatttatttattattggaaaatgaaaagcaactcaaaacaacttcaacctggaggtgcatttataattcagtctgcatttattctgtaaaaaggtgactgttttataaattcttttaatttatgttcaatatatataaaaagtgcatctgttttgtttttcccttttttctccataattttaagaaatgaatctgattgttgtcaacacatttgtgaagtcttgtgctataaaggggaacttcccctaataaaagggccttggaaacctcaaacctgggtttctgacttgaaaaaaatcagtc

SEQ ID NO: 355710 - DNA, 2256 bp, Homo sapiens
ggagggcggcgctcggggcgggaggcccggccgggtccgctaggacagcggggccgctgggaagttgtgagagcggcgctcgggggcgcgcttgcgtgcacgagggcccgggccgcgagcagccgcggccgtcccggtcgccacccttagcagcggtcgcggtcggtgccgaagcggtgttccccgccttagccgctggcgcctcccaagagagcggccggtgggccctcgtcctgtcagtggcgtcggaggccggcgctgcggtggccgcgcccttctggtgctcggacaccgctgaggagccggggccgggcacggctggctgacggctccgggcagctaaggctgcccgaggagaaggcggcggccgcggcgtaggcgcacgtccggcgggctcctggagcctggaggaggccgaggggaccatgtccgggaggcgcttccacctctccaccaccgaccgcgtcatcaaagctgtcccctttcctccaacccaacggcttactttcaaggaagtatttgagaatgggaaacctaaagttgatgttttaaaaaaccatttggtaaaggaaggacgactggaagaggaagtagccttaaagataatcaatgatggggctgccatcctgaggcaagagaagactatgatagaagtagatgctccaatcacagtatgtggtgatattcatggacaattctttgacctaatgaagttatttgaagttggaggatcacctagtaacacacgctacctctttctgggtgactatgtggacagaggctatttcagtatagagtgtgtgctgtatttatggagtttaaagattaatcatcccaaaacattgtttctgcttcggggaaatcatgaatgcaggcatcttacagactatttcaccttcaaacaggaatgtcgaatcaaatattcggaacaggtgtatgatgcctgtatggagacatttgactgtcttcctcttgctgccctcttaaaccagcagtttctctgtgtacatggaggaatgtcacctgaaattacttctttagatgacattaggaaattagacaggtttacggaacctcccgcctttggacctgtgtgtgacctgctttggtctgatccctcagaggattatggcaatgagaagaccttggagcactatacccacaacactgtccgagggtgctcttatttctacagttaccctgcagtttgtgaatttttgcagaacaataatttactatcaattatcagagcccatgaagcccaagatgctgggtatcgaatgtacaggaagagccaagccacaggctttccatcacttattacaattttctctgcccccaattacctagatgtctataacaataaagctgctgtgttgaaatatgaaaacaatgtcatgaatatcaggcagtttaactgttctccacacccctactggcttccaaactttatggatgttttcacatggtctttgccttttgttggggaaaaagtcacagagatgctggtaaatgtgctcaacatatgctctgatgacgaactgatttctgatgatgaagcagaaggaagcactacagttcgtaaggagatcatcaggaataagatcagagccattgggaagatggcacgggtcttttcaattcttcggcaagaaagtgagagtgtgctgactctcaagggcctgactcccacaggcacactccctctgggcgtcctctcaggaggcaagcagactatcgagacagccacagtagaagcggtagaggcccgggaagctttaatgcaacggcagaagcttaagcaactggtcatgagaggtcaagtggtttacttctgtatcccttccatgtacaagagacatccatttgattctcaagagagccaaataggtcagcctcttcagcgattctaaaagatttcaagagcagaggcagaagtagactggaatttagttcaattcatttctgaggttgccctaaggtaggcaagttaaattaactttgtttctatggaaaaccattgggaactgataaacttgtattatacttgtaattgttttattaggtaagatggttcaaaatgcgaatgccttaacttggtgttataaaagttgaatcggaaggaaaatatgtagaagctatttttaagtttttaacttatgtacagctcctggttgtgcaagatagaaagctgtcctaaacgaaaagattagctcttttgttacttttttttgtggtctatgtggcctttgtgcg

SEQ ID NO: 355711 - DNA, 1401 bp, Homo sapiens
gctgctgttcagaggatcccgatgatgtggacagaggctatttcagtatagaggtcgaatcaaatattcggaacaggtgtatgatgcctgtatggagacatttgactgtcttcctcttgctgccctcttaaaccagcagtttctctgtgtacatggaggaatgtcacctgaaattacttctttagatgacattaggaaattagacaggtttacggaacctcccgcctttggacctgtgtgtgacctgctttggtctgatccctcagaggattatggcaatgagaagaccttggagcactatacccacaacactgtccgagggtgctcttatttctacagttaccctgcagtttgtgaatttttgcagaacaataatttactatcaattatcagagcccatgaagcccaagatgctgggtatcgaatgtacaggaagagccaagccacaggctttccatcacttattacaattttctctgcccccaattacctagatgtctataacaataaagctgctgtgttgaaatatgaaaacaatgtcatgaatatcaggcagtttaactgttctccacacccctactggcttccaaactttatggatgttttcacatggtctttgccttttgttggggaaaaagtcacagagatgctggtaaatgtgctcaacatatgctctgatgacgaactgatttctgatgatgaagcagaaggaagcactacagttcgtaaggagatcatcaggaataagatcagagccattgggaagatggcacgggtcttttcaattcttcggcaagaaagtgagagtgtgctgactctcaagggcctgactcccacaggcacactccctctgggcgtcctctcaggaggcaagcagactatcgagacagccatcagagggttctcgcttcagcacaagatccggagttttgaagaagcgcgaggtctggaccgaattaatgagcgaatgccaccccgaaaggatagcatacacgctggtgggccaatgaaatctgtaacctcagcacactcacatgctgcgcacaggagcgaccaagggaagaaagcccattcatgacttagagtcctgccgtggctcaggtggatctaaaactcaagaacaaattctatttatttattattggaaaatgaaaagcaactcaaaacaacttcaacctggaggtgcatttataattcagtctgcatttattctgtaaaaaggtgactgttttataaattcttttaatttatgttcaatatatataaaaagtgcatctgttttgtttttcccttttttctccataattttaagaaatgaatctgattgttgtcaacacatttgtgaagtcttgtgctataaaggggaacttcccctaataaaagggccttggaaacctcaaa

SEQ ID NO: 355712 - DNA, 442 bp, Homo sapiens
tcaagggcctgactcccacaggcacactccctctgggcgtcctctcaggaggcaagcagactatcgagacaggtgagtatgagagtgctcctccatggaaggtgtgctcccgttacctaacagtcagcacacacttacaaatgggggctttcctcagaaaatgccacgagagcagttggttataccataagcggggaaatgaatcttcacccctacttccctccatacagaaaacctaaatcagaatggcttattataacttcagtgtaaaaagcaaaacagtaaaacaagaagaaagtatggagagtagacactggggtagacagagtccttaagtaggacacaaaaagtactaaccttaaaaagccagttgaatttcattaaaataaagaacttctcttcttaaaaatacatgattaagagaggaaaaaggcaagacaca

SEQ ID NO: 355713 - DNA, 416 bp, Homo sapiens
ggcttttgtgtgtcttctagttagacaggtttacggaacctcccgcctttggacctgtgtgtgacctgctttggtctgatccctcagaggattatggcaatgagaagaccttggagcactatacccacaacactgtccgagggtgctcttatttctacaggtaagctagtccttgaggtcgaaaattatgaaaggaaactgtaattcattttatcagatgatttttcagcattttatatttcaaatctatgtagtataagcactcctgtttaatttttcgattaataggaggcaagaaacttgtttgtttgttggctttttatattttcttaggtatatatcctaagaagtgtaatacaccaaacatgattggacatcctgcagtgctctgatatttttgtctgactctaagtgat

SEQ ID NO: 355714 - DNA, 849 bp, Homo sapiens
ggagggcggcgctcggggcgggaggcccggccgggtccgctaggacagcggggccgctgggaagttgtgagagcggcgctcgggggcgcgcttgcgtgcacgagggcccgggccgcgagcagccgcggccgtcccggtcgccacccttagcagcggtcgcggtcggtgccgaagcggtgttccccgccttagccgctggcgcctcccaagagagcggccggtgggccctcgtcctgtcagtggcgtcggaggccggcgctgcggtggccgcgcccttctggtgctcggacaccgctgaggagccggggccgggcacggctggctgacggctccgggcagctaaggctgcccgaggagaaggcggcggccgcggcgtaggcgcacgtccggcgggctcctggagcctggaggaggccgaggggaccatgtccgggaggcgcttccacctctccaccaccgaccgcgtcatcaaagctgtcccctttcctccaacccaacggcttactttcaaggaagtatttgagaatgggaaacctaaagttgatgttttaaaaaaccatttggtaaaggaaggacgactggaagaggaagtagccttaaagataatcaatgatggggctgccatcctgaggcaagagaagactatgatagaagtagatgctccaatcacagtatgtggtgatattcatggacaattctttgacctaatgaagttatttgaagttggaggatcacctagtaacacacgctacctctttctgggtgactatgtggacagaggctatttcagtatagaggtaaaaattaaactggatatgttgggactattatattgtctttcaaaaaaga

SEQ ID NO: 355715 - DNA, 2371 bp, Homo sapiens
ggagggcggcgctcggggcgggaggcccggccgggtccgctaggacagcggggccgctgggaagttgtgagagcggcgctcgggggcgcgcttgcgtgcacgagggcccgggccgcgagcagccgcggccgtcccggtcgccacccttagcagcggtcgcggtcggtgccgaagcggtgttccccgccttagccgctggcgcctcccaagagagcggccggtgggccctcgtcctgtcagtggcgtcggaggccggcgctgcggtggccgcgcccttctggtgctcggacaccgctgaggagccggggccgggcacggctggctgacggctccgggcagctaaggctgcccgaggagaaggcggcggccgcggcgtaggcgcacgtccggcgggctcctggagcctggaggaggccgaggggaccatgtccgggaggcgcttccacctctccaccaccgaccgcgtcatcaaagctgtcccctttcctccaacccaacggcttactttcaaggaagtatttgagaatgggaaacctaaagttgatgttttaaaaaaccatttggtaaaggaaggacgactggaagaggaagtagccttaaagataatcaatgatggggctgccatcctgaggcaagagaagactatgatagaagtagatgctccaatcacagtatgtggtgatattcatggacaattctttgacctaatgaagttatttgaagttggaggatcacctagtaacacacgctacctctttctgggtgactatgtggacagaggctatttcagtatagagtgtgtgctgtatttatggagtttaaagattaatcatcccaaaacattgtttctgcttcggggaaatcatgaatgcaggcatcttacagactatttcaccttcaaacaggaatgtcgaatcaaatattcggaacaggtgtatgatgcctgtatggagacatttgactgtcttcctcttgctgccctcttaaaccagcagtttctctgtgtacatggaggaatgtcacctgaaattacttctttagatgacattaggaaattagacaggtttacggaacctcccgcctttggacctgtgtgtgacctgctttggtctgatccctcagaggattatggcaatgagaagaccttggagcactatacccacaacactgtccgagggtgctcttatttctacagttaccctgcagtttgtgaatttttgcagaacaataatttactatcaattatcagagcccatgaagcccaagatgctgggtatcgaatgtacaggaagagccaagccacaggctttccatcacttattacaattttctctgcccccaattacctagatgtctataacaataaagagtctgcgacacattcttttgattatcctcaatgatgggaaatcttcgtcctttgagggtggatttgatttttggacagccaaaagtcattcggagtcaagactgataaataagctgctgtgttgaaatatgaaaacaatgtcatgaatatcaggcagtttaactgttctccacacccctactggcttccaaactttatggatgttttcacatggtctttgccttttgttggggaaaaagtcacagagatgctggtaaatgtgctcaacatatgctctgatgacgaactgatttctgatgatgaagcagaaggaagcactacagttcgtaaggagatcatcaggaataagatcagagccattgggaagatggcacgggtcttttcaattcttcggcaagaaagtgagagtgtgctgactctcaagggcctgactcccacaggcacactccctctgggcgtcctctcaggaggcaagcagactatcgagacagccatcagagggttctcgcttcagcacaagatccggagttttgaagaagcgcgaggtctggaccgaattaatgagcgaatgccaccccgaaaggatagcatacacgctggtgggccaatgaaatctgtaacctcagcacactcacatgctgcgcacaggagcgaccaagggaagaaagcccattcatgacttagagtcctgccgtggctcaggtggatctaaaactcaagaacaaattctatttatttattattggaaaatgaaaagcaactcaaaacaacttcaacctggaggtgcatttataattcagtctgcatttattctgtaaaaaggtgactgttttataaattcttttaatttatgttcaatatatataaaaagtgcatctgttttgtttttcccttttttctccataattttaagaaatgaatctgattgttgtcaacacatttgtgaagtcttgtgctataaaggggaacttcccctaataaaagggccttggaaacctcaaa

SEQ ID NO: 355716 - DNA, 1608 bp, Homo sapiens
  misc_feature (1600)..(1600): n is a, c, g, or t
ggagggcggcgctcggggcgggaggcccggccgggtccgctaggacagcggggccgctgggaagttgtgagagcggcgctcgggggcgcgcttgcgtgcacgagggcccgggccgcgagcagccgcggccgtcccggtcgccacccttagcagcggtcgcggtcggtgccgaagcggtgttccccgccttagccgctggcgcctcccaagagagcggccggtgggccctcgtcctgtcagtggcgtcggaggccggcgctgcggtggccgcgcccttctggtgctcggacaccgctgaggagccggggccgggcacggctggctgacggctccgggcagctaaggctgcccgaggagaaggcggcggccgcggcgtaggcgcacgtccggcgggctcctggagcctggaggaggccgaggggaccatgtccgggaggcgcttccacctctccaccaccgaccgcgtcatcaaagctgtcccctttcctccaacccaacggcttactttcaaggaagtatttgagaatgggaaacctaaagttgatgttttaaaaaaccatttggtaaaggaaggacgactggaagaggaagtagccttaaagataatcaatgatggggctgccatcctgaggcaagagaagactatgatagaagtagatgctccaatcacagtatgtggtgatattcatggacaattctttgacctaatgaagttatttgaagttggaggatcacctagtaacacacgctacctctttctgggtgactatgtggacagaggctatttcagtatagagtgtgtgctgtatttatggagtttaaagattaatcatcccaaaacattgtttctgcttcggggaaatcatgaatgcaggcatcttacagactatttcaccttcaaacaggaatgtcgaatcaaatattcggaacaggtgtatgatgcctgtatggagacatttgactgtcttcctcttgctgccctcttaaaccagcagtttctctgtgtacatggaggaatgtcacctgaaattacttctttagatgacattaggaaattagacaggtttacggaacctcccgcctttggacctgtgtgtgacctgctttggtctgatccctcagaggattatggcaatgagaagaccttggagcactatacccacaacactgtccgagggtgctcttatttctacagttaccctgcagtttgtgaatttttgcagaacaataatttactatcaattatcagagcccatgaagcccaagatgctgggtatcgaatgtacaggaagagccaagccacaggctttccatcacttattacaattttctctgcccccaattacctagatgtctataacaataaagctgctgtgttgaaatatgaaaacaatgtcatgaatatcaggcagtttaactgttctccacacccctactggcttccaaactttatggatgttttcacatggtctttgccttttgttggggaaaaagtcacagagatgctggtaaatgtgctcaacatatgctctgatgacgaactgatttctgatgatgaagcagaagaagcactacagttcgtagggaggttcttcggggnttaggttc

SEQ ID NO: 355717 - DNA, 790 bp, Homo sapiens
agctttttgttaggtatatgtctaccatgattatgcatatagagcttttatgaaaattactttcacaatttcagctgccctttgggctttaaggaagcagtagctgcagccaagactgattcagtcagacattgcccatgactttcactagacgtgtgctccatagccacctttctgtgtgtttctctaggaggttgctgtgtgctaagaaactttttttaagcctgttgctttgctgcctaattgagctctctccacctgcttcctgtttttctgtagccatcagagggttctcgcttcagcacaagatccggagttttgaagaagcgcgaggtctggaccgaattaatgagcgaatgccaccccgaaaggatagcatacacgctggtgggccaatgaaatctgtaacctcagcacactcacatgctgcgcacaggagcgaccaagggaagaaagcccattcatgacttagagtcctgccgtggctcaggtggatctaaaactcaagaacaaattctatttatttattattggaaaatgaaaagcaactcaaaacaacttcaacctggaggtgcatttataattcagtctgcatttattctgtaaaaaggtgactgttttataaattcttttaatttatgttcaatatatataaaaagtgcatctgttttgtttttcccttttttctccataattttaagaaatgaatctgattgttgtcaacacatttgtgaagtcttgtgctataaaggggaacttcccctaataaaagggccttggaaacctcaaa

SEQ ID NO: 355718 - DNA, 798 bp, Homo sapiens
gtttctaaagaccaaaaagggagacggggagttggctggtacaaaattgcctgtcaggaactccctgaagtttacagaaataacattgattaatgattagctatacattgttcagctacagggagtgagagatggtgtccagtgcagcatgtttaggttgctttatagccacttgtgatgatagcaagctgttttaatagatgaatacacggcttcaaaacagggacataagacattgttgctgtctcattttaatgcctaactctgggcttgttaatttgaaagcactcactttcctcacataaaatttcttttctttcctcagacatttgaattctttatagtttaggaatattttgaataaatatgtatttgttttacatgtctttggtaaaccatattcacgtttctctagaaatagaaattccaatagaaatataatgccaggcatatacgtacttttaaatgtattagtagacatgttttaaaaagtaaaaagaaagaggtgaaattattttttataatatatattcaactaaatatatttaaggtattatcattaccccatgtgacactagcaagatttcaagtgttcaatagctacccgtggtttgtggctatcatattggaaagcacaagtctatggggtagaaaagttgaatttctgggtcatagcatatatgtatgtgtgttttaccactagaatatacaggcaaacaattttccaaagtttttgaacttatttatactcttgccagaaatgaatagaagattataatgcttccgttgtgccaaaat

SEQ ID NO: 355719 - DNA, 2425 bp, Homo sapiens
ttctgggggtttattttaccatttacctctgacaggatggctgaagaggaatcatcctgggagttggttataatattatttatttaaaaatatttatcatttattaagtacttcttaggtgacaagaaccataagagctttccatacattgtttcattcaatacttacacaattctaatgttatctccatttttcagataggaaaatgaagttaatcagatgttgagcttagatttgaatcgaggactatttaatgccaaagcttaagattctttaagtcacacacacacagacacacacacacacacacacacgacgtgtgtttaaattttgagtttccaaggaaaaagaaaacatgaactatagaaaagaaaaatgaaataaaacaaatatggaagaaaatgaagacactgagcagaagcggcctagaaatctgcaaagagaaagagaaagtcaaggcagggaggttttgtagggaaagttttaagtgtcttgatctgttactaattatgtgttcttagagacatacaatctgagtctcagttttcacagatatattaatgaggtcatttactagatggtctctatattttatttcagctctaagattatacattttcttcttagagctttttatttatcgttttgtataaaatcaacttaacaagtttaatagttttcactaaatcccacaagaagcaaaatgttctgttaggcacccaatgtgaacagtggatttcataattcaccaagagaagcaatctgccagcataccaagaggatgtgacaattgccatgggtttcgcacgcacaggtcctacaaaaagtcattcactgtcaaaaaaaaagtttgtctagtttgtttgaggttcttgcttggcatgaagtcctcatggataatccctacgcttttttttgtggttaaaaactgggataaaagcaaatttttgatcttttaacttttaaacagtaaacaataccattacttaattatgacactttttttgtgagaaagggtatggggaaatgtgaaaagtgctttgaagaataacttaaaaagcctcttttgagtctttttccatcttcttcatttttctctgtatctacaaatgagtagattttctataactactagttgctgtttggtcaatctttaggaaaaggttaaaaggccaccgtcagtagtgagggcaagaggagaaaagcacaagctagagaagctctagaccagattgccaacttagctccacaagcctgattctgtcctgaagggtttcccagataatgtcggtaatgcagttaggaaaagcagtgtgagtgtttctgggacgaatgagatggagaaaataaaacaaaatacattattatttgagaaagagaaatgtaaaaaactcactattttactgtgttaaaaaaaagatggcacatttattgctacataaatgttatatacatattgtgttttctgttacagtgacagaaaaaaatttgaacttcttgctgctggttgaaaaggtttatcaataataccttgaatttgacacaggatacaaatctgcaataaaccaacaatggaaactggagaacaagatgagaagcaattcatctccaacaattagctcttacaatactccataggtactacacggtatgctagaatcctactatggtcttaaaatgctattgtaaatttctgatattaatgaacaggttatggtaaataaccctacattttttactacctaatataataaaataaagtaagaaactttttactgaaaactttttgatttcaaaaatctagaaagagtaatatttagaattcaagaaattttcttacaagattattgtataaaagactagctacagtgaaaaataagccaaatgtttttttctttctattttatgaaggaaagcttctgggcatactgcaaagtctaatatagcgaaaaagacaacaagctctgaagaaaaaaaggccaggcagtggcatatgttcactcacacatcataagcaacaacttctgtttagctgattaacactgaaatgaagaacaaggccacagatagagtccgatgtaactggagaatatatgcaaattaaagtaaccaaaaagtccactaagttcacaaatgactgacttgttaggaatcatcctgattagagtaccagaagttctgtcttgtttttgttctttcaaattaacagaaatctttaagctacatagtgatttgggtcctttcctctgtgtgctgattgccactgttgatattggctataaggaattattaagccaagatacctcctttagcatgtttttctctcccagggttgttgtggtggaagacaggtttcatggaagttcaaagtgattatgtcttttaaaacaactcctaaggattagagacagagagtgccttaatg

SEQ ID NO: 355720 - DNA, 561 bp, Homo sapiens
gacaaaatggctcagagaccctggggacccagcgtagtggaacactgaccctcaagagtgagaaaggagaccctggcagaagacagcagaggggatcgtgaaaccagtccccaacagacacggagaaatgacattactaaacacagcaactttatgggattgtatccagattacataagcccacaccagagccaaagaagatggaggaggaatgggattcattcttccagacaatacgttgacagaaaaaaatttgaacttcttgctgctggttgaaaaggtttatcaataataccttgaatttgacacaggatacacagatgatgaatagaacatgagactctagagagtcaccagtatatttctgtattatatgtcaaacacagagaacacacaatacggaacaaaagcgtgagtggaaaactttatctggttgatttagctggtagtgaaaaggttagtaaaactggagctgaaggtgctgtgccggatgaagctaaaaacatctacagtcactttctgctcttggaaatgttatctgctttagactgaggaccatcg

SEQ ID NO: 355721 - DNA, 541 bp, Homo sapiens
aagtggctagagtgggcatccttgtcttgtttctgatcttagaggaaaagcttccaacttttcaccagtgagttaggatgttagctatgggtttgtcatagatgcttctttattgtgttaaggtacattccttctataccaaatttaataagatcaaatacattaaaatatgctcaagttccacattaaacagcaatttagttttgctataacaattttgtatgacttttgtaattgtatttgaaattaatttcattttgcattttttttcttttggcactgtaatattttttcagattgcaaacattttcacaagctttgaaagacttggaaatcttgcacatggtgctcaccaagcccaaagacaaaatggctcagagaccctggggacccagcgtagtggaacactgaccctcaagagtgagaaaggagaccctggcagaagacagcagaggtaccacatgacagtttggggaagggattgaaggtctgcgtcaaagagaacagaaaacctctccaggttgtcttttggcaataacta

SEQ ID NO: 355722 - DNA, 1011 bp, Homo sapiens
ggggccgccaccgccgccgggccgagggagggcccggcaaccgccgcctgcgcgccggctgcccctcggctcctgggagccgcggcgctacgggcctgccgagcactcgggcgggcgccgagcaggctgggccccggcgcagtggcctagcctggaccgcaaggccgaagccgcctccgggccgcgtcccggtgtttcgggttgtgtaaccttggccaaaatgcttaagcttttttcctggctgccaaatggggccgatcgtctgacctgctgcctccggaacttgagggatcagatcaaataaccctttcctggcgctcgtctgccgctgtgaatgaatcacgggctcctgtaatcaccgttaggagagattgttaaactcgtacagggttggatgttttaaagttactgaatatttactggacccctactgttcaatcaagacatgctaagttagcttgccattcttgttcatttatgtgtttacttaactatttctgggtctcctcttcccagtcataaatatctcttggagtgtaagctcctcggagcagagatcctgtttccgtatttcctgtacctagaacagtgccagatccgtagtagacactgaaacaaaaaatctttaaaaaaaaaaatatatacgaatgtggcaccaccatttacacaggccactaagccaaaaatctcgaacttgtcagattgtctcttctcagccatcagcagtcaacaagttctagcatttggtctcttaaaagtggttcaagagtttatttttcctctccttcctctgccagtaccaaccagtcttccgtatcactatgtattgcaagagtctcacaagaagatatccatcactgactgatcttcctcccgtttaacatccccaacaggtgccagggtgatgttttttttattctaaaaagaaaccagattatatcgctcactcccttgcttaaaacagttcttcaatgttaggtaaataaatcatggagtcaccacgagggcgtt

SEQ ID NO: 355723 - DNA, 483 bp, Homo sapiens
aaagggataagaccagagacttggggagcagtgtttcatttatgaggtcaaactgaggttgagaagccaacgaatgaacctgagaaggagcagaacagtgagcagagtaccaaagagcccagagagtgcaggataatggagtctgagtgcaggataatggagtctgaggaagacaagagcaatgggagagggagtgtttaaaagcagtgaactctcgagggtgggcacggtagctcacgcctgtaatcccagccctttgggaggctgaggcaggcggatcacctgaggtcagcagtttgagaccagcgtgaccaacatggagaaaccccgtctctactaaaaatacaaaaaattagccgggcgtggtggcgtatgcctgtaatctcagctactcaggaggctgagacaggagaatcgtttgaacccaggaagcggaggttgtagtgagccgagatcgtgccatcgcaagcgaaactctgtctc

SEQ ID NO: 355724 - DNA, 388 bp, Homo sapiens
ggcgaaaaataactttacagtggagaaacttgacaaacactgtgccagccaggtaagcaagatcaatatcatcatttggatagtatttacctctaatatgatgtgaggaaagacactttatctctggtctttttcccaaaagcttataaccccagtaaaatcatgagaaaagtatgaggcaaattccaataaatgagcattctacaaaatatctaaccagtgctccccaaagctgtcaaggtcatcaaaaacaaggggagtctaagaaactggtaggaaaaagagcctaaggggatatgccaactaaatgtaatgtggtacctgaatgagaacatgggaagagaaaggacatgaggtaaaaatctcaggaaatctgaatgagatacgg

SEQ ID NO: 355725 - DNA, 428 bp, Homo sapiens
taacatggctctttaatttttccagggttttgttggggaaaatctgggaaataaaaagaaatgttaaatccacccttcttccattttgcttctccagctgccagagtctctcctggtaggcggatcttagctttctgtctctggaagttcctactccacccctgaccttcagccagaatggaaggcaagatggggacacagaacgggtttatcatgacgacgaagacaattctaaacaagggaggagggcgtggtctccacctctccttccccattcaatcaaacatcaagcgctgactctgctatgtgtccagcccttaggagtgagagagacatgagcctgaaggctcagacaagctccttaaccccgctaagcctgcttctcacctgcacaatggggataataaaacctacttccaaggggaatt

SEQ ID NO: 355726 - DNA, 374 bp, Homo sapiens
atcaatcgtttgtccctgcgatcttaaaaaatatttccacccgctgccagagtctctcctggtaggcggatcttagctttctgtctctggaagttcctactccacccctgaccttcagccagaatggaaggcaagatggggacacagaacgggtttatcatgacgacgaagacaattctaaacaagggaggagggcgtggtctccacctctccttccccattcaatcaaacatcaagcgctgactctgctatgtgtccagcccttaggagtgagagagacatgagcctgaaggctcagacaagctccttaaccccgctaagcctgcttctcacctgcacaatggggataataaaacctacttccaaggggaatt

SEQ ID NO: 355727 - DNA, 380 bp, Homo sapiens
ttaacactttctcttggcgggtgacacgggcagggaagaacaaaggctgctgccagagtctctcctggtaggcggatcttagctttctgtctctggaagttcctactccacccctgaccttcagccagaatggaaggcaagatggggacacagaacgggtttatcatgacgacgaagacaattctaaacaagggaggagggcgtggtctccacctctccttccccattcaatcaaacatcaagcgctgactctgctatgtgtccagcccttaggagtgagagagacatgagcctgaaggctcagacaagctccttaaccccgctaagcctgcttctcacctgcacaatggggataataaaacctacttccaaggggaatt

SEQ ID NO: 355728 - DNA, 366 bp, Homo sapiens
ctacatccgtgaaagccgcccaaaaaaacgcgtgactgccagagtctctcctggtaggcggatcttagctttctgtctctggaagttcctactccacccctgaccttcagccagaatggaaggcaagatggggacacagaacgggtttatcatgacgacgaagacaattctaaacaagggaggagggcgtggtctccacctctccttccccattcaatcaaacatcaagcgctgactctgctatgtgtccagcccttaggagtgagagagacatgagcctgaaggctcagacaagctccttaaccccgctaagcctgcttctcacctgcacaatggggataataaaacctacttccaaggggaatt

SEQ ID NO: 355729 - DNA, 724 bp, Homo sapiens
gcccaggagaagcaagggcttagagaagaatccaactgtgacatcgagaagagcctgtccagtcccttcccagtagtggctctggggcccaggcccggcttccagaagatggggcagctctactctggggtcaaagccaactactgcttggctgccagagtctctcctggtaggcggatcttagctttctgtctctggaagttcctactccacccctgaccttcagccagaatggaaggcaagatggggacacagaacgggtttatcatgacgacgaagacaattctaaacaagggaggagggcgtggtctccacctctccttccccattcaatcaaacatcaagcgctgactctgctatgtgtccagcccttaggagtgagagagacatgagcctgaaggctcagacaagctccttaaccccgctaagcctgcttctcacctgcacaatggggataataaaacctacttccaaggggaattaaaaaaaaaaaaaaaaaaagacaaacaacaaaaaaaaaacaaaaaaagaaaacaaaacgaagacaaacacagagcagcatcaagagacaacacacaccacaccaaaacacacaacaccagaaacaagacagcagaccaaaaggaagggggcgggcgccaaacaaaacaccgctgcccggggggcacacagacacgccacagcaccgacagggcagcacgcgcccccacgatgagacacaacg

SEQ ID NO: 355730 - DNA, 380 bp, Homo sapiens
ttctatgtgcgcgcgtcgccacgatcccccggaggagggaggagctcagctgccagagtctctcctggtaggcggatcttagctttctgtctctggaagttcctactccacccctgaccttcagccagaatggaaggcaagatggggacacagaacgggtttatcatgacgacgaagacaattctaaacaagggaggagggcgtggtctccacctctccttccccattcaatcaaacatcaagcgctgactctgctatgtgtccagcccttaggagtgagagagacatgagcctgaaggctcagacaagctccttaaccccgctaagcctgcttctcacctgcacaatggggataataaaacctacttccaaggggaatt

SEQ ID NO: 355731 - DNA, 1507 bp, Homo sapiens
cggcggttcaggtcgcttagagagtcgtaggttgggtagtgcgggttggggcgggggctgcggagagggtgctcggcttccgctaccaagacctccgacagaaaatccggccagtggccaaggagctgcagttcaactacattcccgtggatgcggagattgtctccatcgacactttcaacaagtcaccccccaagcggggtctggttgtggggatcacgttcatcaaggattcaggggacaagggcagccccttcctgaacatttactgcgactacgagcccggctctgagtacaaccttgactctattgcccagagctgcctgaacctggagctccagttcactccgttccagctgtgccatgcggaggtccaggtcggggatcaacttgagactgtgtttctcttgagtgggaacgacccggccattcatctctacaaggagaacgaggggctgcatcagtttgaggaacagcccgtggaaaacctcttcccagagctgacgaacctgaccagtagcgtcctctggctggacgtccacaacttccccggcacgtcccggcgcctctcagctctgggctgtcagagtggttatgtccgtgtcgcccacgtggaccagcggagtcgagaggttctgcagatgtggtcggtcctgcaggacggtcccatctcccgagtgattgtgttcagcctctcggccgccaaggagaccaaggacaggccactacaagatgagtacagcgtgctcgtggccagcatgttggagccagcagtggtgtatcgggacctgctgaaccggggtcttgaagaccagcttctcctgcccggcagtgaccagtttgacagcgtcctctgcagcctggtcaccgatgtggatttggatgggcggccagaagtcctggtggccacctatggacaggaactgctgtgttataagtaccggggcccagagtcggggcttcctgaggcccagcacgggttccatctgctgtggcagcggagcttctccagtcccctgctggccatggctcacgtggacctgaccggggatgggctgcaggagcttgccgtggtctccctgaagggcgtgcacatcctgcagcacagcctgattcaggcctcagagctggtcttgacccggcttcgacatcaagtggagcagaggagacgtcggctacaggggttggaggacggggcaggtgcagggcctgctgagaatgcagcctcttaagcacccatgcacccactcttcccagacctggggcgactcatggcgtgctcacctccagccgctggtggggggtgtcctgaaggacaggatgctctccccagacctccccagggtggtgaagctgtgccctggggccccagctaacccactcctctctctgtacgtcaatgtccctatttgaaagcagggatgatcccattccaccctgtccactctggatgagaattggccacctgatggttatttatacgtccagaagaacatcatttcccagt

SEQ ID NO: 355732 - DNA, 1451 bp, Homo sapiens
tgctggggggcgggggcctggaacgtggtgttgagaaggcttctgaggctctgtctgagccggggtcaccgtgctggaagaatgggatcagtggatgcggagattgtctccatcgacactttcaacaagtcaccccccaagcggggtctggttgtggggatcacgttcatcaaggattcaggggacaagggcagccccttcctgaacatttactgcgactacgagcccggctctgagtacaaccttgactctattgcccagagctgcctgaacctggagctccagttcactccgttccagctgtgccatgcggaggtccaggtcggggatcaacttgagactgtgtttctcttgagtgggaacgacccggccattcatctctacaaggagaacgaggggctgcatcagtttgaggaacagcccgtggaaaacctcttcccagagctgacgaacctgaccagtagcgtcctctggctggacgtccacaacttccccggcacgtcccggcgcctctcagctctgggctgtcagagtggttatgtccgtgtcgcccacgtggaccagcggagtcgagaggttctgcagatgtggtcggtcctgcaggacggtcccatctcccgagtgattgtgttcagcctctcggccgccaaggagaccaaggacaggccactacaagatgagtacagcgtgctcgtggccagcatgttggagccagcagtggtgtatcgggacctgctgaaccggggtcttgaagaccagcttctcctgcccggcagtgaccagtttgacagcgtcctctgcagcctggtcaccgatgtggatttggatgggcggccagaagtcctggtggccacctatggacaggaactgctgtgttataagtaccggggcccagagtcggggcttcctgaggcccagcacgggttccatctgctgtggcagcggagcttctccagtcccctgctggccatggctcacgtggacctgaccggggatgggctgcaggagcttgccgtggtctccctgaagggcgtgcacatcctgcagcacagcctgattcaggcctcagagctggtcttgacccggcttcgacatcaagtggagcagaggagacgtcggctacaggggttggaggacggggcaggtgcagggcctgctgagaatgcagcctcttaagcacccatgcacccactcttcccagacctggggcgactcatggcgtgctcacctccagccgctggtggggggtgtcctgaaggacaggatgctctccccagacctccccagggtggtgaagctgtgccctggggccccagctaacccactcctctctctgtacgtcaatgtccctatttgaaagcagggatgatcccattccaccctgtccactctggatgagaattggccacctgatggttatttatacgtccagaagaacatcatttcccagt

SEQ ID NO: 355733 - DNA, 1671 bp, Homo sapiens
cggcggttcaggtcgcttagagagtcgtaggttgggtagtgcgggttggggcgggggctgcggagagggtgcttaactgaggggcatgatgggggaggcggccgtggccgcggggccttgtccgttgcgcgaggacagcttcacgcgcttctcgtcgcagagcaatgtgtacgggctggcaggcggcgccggcgggcgcggggagctgctggccgccacccttaaaggcaaggtgctcggcttccgctaccaagacctccgacagaaaatccggccagtggccaaggagctgcagttcaactacattcccgtggatgcggagattgtctccatcgacactttcaacaagtcaccccccaagcggggtctggttgtggggatcacgttcatcaaggattcaggggacaagggcagccccttcctgaacatttactgcgactacgagcccggctctgagtacaaccttgactctattgcccagagctgcctgaacctggagctccagttcactccgttccagctgtgccatgcggaggtccaggtcggggatcaacttgagactgtgtttctcttgagtgggaacgacccggccattcatctctacaaggagaacgaggggctgcatcagtttgaggaacagcccgtggaaaacctcttcccagagctgacgaacctgaccagtagcgtcctctggctggacgtccacaacttccccggcacgtcccggcgcctctcagctctgggctgtcagagtggttatgtccgtgtcgcccacgtggaccagcggagtcgagaggttctgcagatgtggtcggtcctgcaggacggtcccatctcccgagtgattgtgttcagcctctcggccgccaaggagaccaaggacaggccactacaagatgagtacagcgtgctcgtggccagcatgttggagccagcagtggtgtatcgggacctgctgaaccggggtcttgaagaccagcttctcctgcccggcagtgaccagtttgacagcgtcctctgcagcctggtcaccgatgtggatttggatgggcggccagaagtcctggtggccacctatggacaggaactgctgtgttataagtaccggggcccagagtcggggcttcctgaggcccagcacgggttccatctgctgtggcagcggagcttctccagtcccctgctggccatggctcacgtggacctgaccggggatgggctgcaggagcttgccgtggtctccctgaagggcgtgcacatcctgcagcacagcctgattcaggcctcagagctggtcttgacccggcttcgacatcaagtggagcagaggagacgtcggctacaggggttggaggacggggcaggtgcagggcctgctgagaatgcagcctcttaagcacccatgcacccactcttcccagacctggggcgactcatggcgtgctcacctccagccgctggtggggggtgtcctgaaggacaggatgctctccccagacctccccagggtggtgaagctgtgccctggggccccagctaacccactcctctctctgtacgtcaatgtccctatttgaaagcagggatgatcccattccaccctgtccactctggatgagaattggccacctgatggttatttatacgtccagaagaacatcatttcccagt

SEQ ID NO: 355734 - DNA, 1503 bp, Homo sapiens
cggcggttcaggtcgcttagagagtcgtaggttgggtagtgcgggttggggcgggggctgcggagagggtgcttaactgaggggcatgatgggggaggcggccgtggccgcggggccttgtccgttgcgcgaggacagcttcacgcgcttctcgtcgcagagcaatgtgtacgggctggcaggcggcgccggcgggcgcggggagctgctggccgccacccttaaaggcaaggtgctcggcttccgctaccaagacctccgacagaaaatccggccagtggccaaggagctgcagttcaactacattcccgagagctgcctgaacctggagctccagttcactccgttccagctgtgccatgcggaggtccaggtcggggatcaacttgagactgtgtttctcttgagtgggaacgacccggccattcatctctacaaggagaacgaggggctgcatcagtttgaggaacagcccgtggaaaacctcttcccagagctgacgaacctgaccagtagcgtcctctggctggacgtccacaacttccccggcacgtcccggcgcctctcagctctgggctgtcagagtggttatgtccgtgtcgcccacgtggaccagcggagtcgagaggttctgcagatgtggtcggtcctgcaggacggtcccatctcccgagtgattgtgttcagcctctcggccgccaaggagaccaaggacaggccactacaagatgagtacagcgtgctcgtggccagcatgttggagccagcagtggtgtatcgggacctgctgaaccggggtcttgaagaccagcttctcctgcccggcagtgaccagtttgacagcgtcctctgcagcctggtcaccgatgtggatttggatgggcggccagaagtcctggtggccacctatggacaggaactgctgtgttataagtaccggggcccagagtcggggcttcctgaggcccagcacgggttccatctgctgtggcagcggagcttctccagtcccctgctggccatggctcacgtggacctgaccggggatgggctgcaggagcttgccgtggtctccctgaagggcgtgcacatcctgcagcacagcctgattcaggcctcagagctggtcttgacccggcttcgacatcaagtggagcagaggagacgtcggctacaggggttggaggacggggcaggtgcagggcctgctgagaatgcagcctcttaagcacccatgcacccactcttcccagacctggggcgactcatggcgtgctcacctccagccgctggtggggggtgtcctgaaggacaggatgctctccccagacctccccagggtggtgaagctgtgccctggggccccagctaacccactcctctctctgtacgtcaatgtccctatttgaaagcagggatgatcccattccaccctgtccactctggatgagaattggccacctgatggttatttatacgtccagaagaacatcatttcccagt

SEQ ID NO: 355735 - DNA, 1241 bp, Homo sapiens
cggcggttcaggtcgcttagagagtcgtaggttgggtagtgcgggttggggcgggggctgcggagagggtgcttaactgaggggcatgatgggggaggcggccgtggccgcggggccttgtccgttgcgcgaggacagcttcacgcgcttctcgtcgcagagcaatgtgtacgggctggcaggcggcgccggcgggcgcggggagctgctggccgccacccttaaaggcaaggtgctcggcttccgctaccaagacctccgacagaaaatccggccagtggccaaggagctgcagttcaactacattcccgtggatgcggagattgtctccatcgacactttcaacaagtcaccccccaagcggggtctggttgtggggatcacgttcatcaaggattcaggggacaagggcagccccttcctgaacatttactgcgactacgagcccggctctgagtacaaccttgactctattgcccagagctgcctgaacctggagctccagttcactccgttccagctgtgccatgcggaggtccaggtcggggatcaacttgagactgtgtttctcttgagtgggaacgacccggccattcatctctacaaggagaacgaggggctgcatcagtttgaggaacagcccgtggaaaacctcttcccagagctgacgaacctgaccagtagcgtcctctggctggacgtccacaacttccccggcacgtcccggcgcctctcagctctgggctgtcagagtggttatgtccgtgtcgcccacgtggaccagcggagtcgagaggttctgcagatgtggtcggtcctgcaggacggtcccatctcccgagtgattgtgttcagcctctcggccgccaaggagaccaaggacaggccactacaagatgagtacagcgtgctcgtggccagcatgttggagccagcagtggtgtatcgggacctgctgaaccggggtcttgaagaccagcttctcctgcccggcagtgaccagtttgacagcgtcctctgcagcctggtcaccgatgtggatttggatgggcggccagaagtcctggtggccacctatggacaggaactgctgtgttataagtaccggggcccagagtcggggcttcctgaggcccagcacgggttccatctgctgtggcagcggagcttctccagtccccttgacggctgtaaacctgggggaccgaggcctcggaatttcggaactccaatgggccata

SEQ ID NO: 355736 - DNA, 876 bp, Homo sapiens
attattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgtgaacttttaatgaagacattttaaattttgttctgagatatttaaattctgcatgggtattttttcactaattgctttacttggataccaatttgaataatttctgaaattgtaatattgtgataatttgcacagcattgtacatgcacatctgtaaatgcaatcttaattgccatatttatgcaatctgtgtaccaatttggacaaatgtttatatattttacataaagctgtctgtatgca

SEQ ID NO: 355737 - DNA, 1209 bp, Homo sapiens
attattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgtgaacttttaatgaagacattttaaattttgttctgagatatttaaattctgcatgggtattttttcactaattgctttacttggataccaatttgaataatttctgaaattgtaatattgtgataatttgcacagcattgtacatgcacatctgtaaatgcaatcttaattgccatatttatgcaatctgtgtaccaatttggacaaatgtttatatattttacataaagctgtctaaatgcaatcatgattgcatttagacccaggtgtcttcagtgtcatattaatttagaaacactgaactatatcattgtgtagagttcatttttgagtaaatcacagagaaacgctctgagatgatcatgtactgattatttacggactattaatgtcacatgcttcctcttcctgccttgtgtttgaaattaattgtccctttctcagtgcattctatgcctttttcacgactttttttttttggatacgggttctcctttggtcttccaggtggaattgtggtgccttgactcatggctcatcattgcaccctttttgattgggctgtttaaatgcaat

SEQ ID NO: 355738 - DNA, 791 bp, Homo sapiens
tccttgttttttgattgtagagctccgcgttaaaatgtgtcccgaaattatgttatccccgtgctggcccacaaattttctcgacggcgccgcgtcatttattgccccctttggggttacaccgcgtaaagcccctggaaaaggttgataaattgtgcccctcggaggcctttcataactctccttgaggtagagtgtggcccccaattagtgtgcccccccccccccgggatttaagggggttctccttttcccccaggggtccccccgggcttgccgcggtttttccccgtgctcccggcgcctttgtgtttttaccgcgcgcgcgcgccccgtgggcgctctatcgcgctgtttctatatatatatctccgcgctccccctcttatgggggcgccccccttgtgacaccaacaaaaacccctgggtgtctcgcccttaatccttgggcgccccccccgggggtttttttcccccccccccttttttttttttttttttttttttttttttttttttttttttcttctaaatttaagtagcatcctgctgctaccatattaaagctaaaatttaacttttgctgaagaatcagctaattcaggtaatccaaatatttgtggaaaaacatctggataatttattgaacacattagtattgtgttagctttgatcattcccatttcataggtttttattgtggaatagtcaacttaatatagattcactttcaatttgcatgtataaagtaatactcaataaaatttttttcatttatttttcaaaagtgg

SEQ ID NO: 355739 - DNA, 774 bp, Homo sapiens
cagctggtactccgtctcatttttgggaatgcaagagagagtgatgggcagaaaatctcacggactccaaataaagatcacagtgactccttagccctagctgcagttgctgtgcaggtatgtggtccctctttatcagataactgaatcttttttaagataacctgaaaagtccaatttttctgtgaagtcttgatttttgaatactggaactaattttaagactttatatgggacaaacacacttgcataacgaacagtctctgctttgcaaccatgaaggattttttaaatgtatcctttatagctcatatgctacattaagctgttttaatattgcaaagtaatcaatgagaaattttaaagtaataggagagcagaaaagtaatttgttcttttaccctaatttttatagctttatgaacaaattctagctgaaaatgaaaagctgaaggcacagctacatgatacaaatatggaactaacagatcttaaattacagttggaaaaggccacccaggtttgtacccttttctttttgttactctcaaggtaatggttgtgatttatcccatctaaaaatggtattaaaattttttctaatactctaaatagaagtttgataattggtaatagaagataatgctgtttatggatgatttactttttctggagtaaatttaaaaaatagtcatagtcaaaagtcaacttataaaaagccttttaataccaatgttgtggtatgtcaaggttttaaatgtttatttccagaat

SEQ ID NO: 355740 - DNA, 344 bp, Homo sapiens
tactgcttgactaaatatcagcattatttattatctgggaaagagtgtcttggaaatagtttcagtgtgattaaactaaatttaaatggtttgtatctgaaaggtgaccggcaagagtcagtatcttctgggcggtatgacctaaccagttttacagctcatcaattactgctgcttgctttttgcataacaccccagaatgcttatcatttaagggagaataaaacagtacactgcaataatgtgttgtgtgttggctttgcctgtcactctttgaaacaagtttaaaataaacgctgcagttgcttttctattacactcactgcattaatgctacacataat

SEQ ID NO: 355741 - DNA, 477 bp, Homo sapiens
ttttcattgtgtgggaataatgattaacttctacagttacaaataagttgctactataaccatatgtccttggggaatgttaatttttttaagctcaatagaaaatattcttggcatttttcttgctgaatactagggattttaataaaatgtttatatttccacagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatcgagatgctattgaaacttctaaactaggggagccggctcgac

SEQ ID NO: 355742 - DNA, 1020 bp, Homo sapiens
gatcacaccactgcactccagcctgggtgacagagcaagactctacctcaaaaataaaaataatcaatatagtttcaatgaagcaaagcatctcaggtaacaatttgagcataactttaaccataacttatgatagcataataacattcattagtaattcagtagccgtatgtgccaggctgtgttaggtgctttatatattgtttaatttttaaaaacttgtggagtgtacagattggtaaggtgacattgtatcacaaagctagtctttgagtccaaagttttgtggttttatgttatgatatacttttatcatggaattgtcttattaaatgttttgccagtggttcttaaagtgtgtttctgacaccagtagcattgacttcacttagaaacctgttagaaatacaaattatttggccccacccaacacttgagtcacaaactttgcagatggggctcaatctgttttaacaagcgcttcatgtaattttgatgcaggcctaagtttttgagccactgcagtatgcatttctatttttaagcaaagatcttggtctttctttttggacattgtagaaataacatgaacttgttttttgtttgtttttgttttgttttgttttaagctcctgatctttgttggttatgttgcaaaagattgtatcaggagaagcctcagcatggacattggcatcctgacataacccccattaatttagtattctttctgaaactcaaatggattctcaagtccaagagactatggaataaaatcattgtttgtctgtgttaagttttatctctgttattgcctgaagacttttggtaacaataatgcgctttcatcaaacttttaagacttgattggaaaaaataaatgtatgtttcatcagttatacaatttgttttgtatgtgttttgtatgggtggtccctgaggagcctgaatcttcaaaatatactttctgtgagctcagaaaatgaatagcacttttgagctaattgatcagtgtggaga

SEQ ID NO: 355743 - DNA, 5457 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaaatgttaccagacctaaaagcagacaaccagaggctaaaggatgaaaatggggccttgatcagagttataagcaaactttccaaataaaaaaaaaaaagcagcaagtaatggaattgcacatattagtaacccagtggaccataattggcagtcactggaagtctgggaagaatccttggagactgtcattttcggatatcctgccaaatgccctcttatctagaatttttgtttcattttgtttaattttctggggtgtttttgttgttgttggtttgttttttgtttttttttttaatcaagaccattgtttcatgttaatgcagctgctgagaagatttttttttaatgactgagaaaacttgtttacagctccagcatataaggaaagtgttcaaggccagatatgcctcagatatttaaccagtaagccttagttgtacataaatacttttgtgtcaacaaaaactttcagctctcacagaagacagttactcaacattttttgatgtgccacagtttcgagtttttcgatatttaaattttttggcttttcatctaagtttgggtttgtattttttccttctaaactcttcatgtggcagagtcttctatgttttcacagctttttcattacagaaaagaacacttgctcttctgtgattattgtcatgtattaggctaatgctgtgttgtctcccacctggaactgaattgcttggtggaacatatgctttcactgtttgtgcaatatgcatttatttcttatatgaatgctttaaagtcatttgaggttagatcttttaattcctattttctgcttcattggtcactttttttttattgtagtataagatgttagattctgtaatcttcacattcattttagcaggtactgagtgatgctgtatatacaaataagtgtattgttttgatttttagaccaccacatggcatgcttgactatttcttatttcaaatgtctgctaatgcagagtaggctactccatgatagtgttaaaaaacaaaatttgctaacaatgtgatataaagactttaaaagttacacattatgtggagccctatctttacaaaagtttcctactgtaaagtgcttttattttcagttttcacttgatagtactcaaccataattaaagttgcataagataattgctttacatttcacatacctatatttatctgagtgctgtctaaaactgttgtgctagccaaagtaatgctatgaaatcatttgcagaattaacccgtgagttaatgttaaatgcactgttattgccatgtgaagaggcatcgactttgataccaccatcatgttcagaccattttatacatttcagtggccttttttttttttaaggaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgaaaaaaaaaaa

SEQ ID NO: 355744 - DNA, 8761 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaatattgaaaaattgaatcactttaactcctgaaaaacatacaattgtaatttcaatgtaaaatttcttatgtaggtactacctttttttatcgttccaaggtttgctagtgaacacaggatattttaaaagttttttattcttcgggcctggaaagtgtacaaagtcagtgtaggagaaaaaaatccatatttttatattagcatgcacactaaaaaccaaaatattattcatacttaaaacattcatacaaaacaatatgtaagcagaaatagtactaaaatactttgcctaatttctaagttgaagaataacactgggacacagttttttcatatgagagaatattccgctatttcaaatttaagggattttcttcctaacattgaaattttaaaaacagagttacttctaaataattatacagattttttcttctattaaatattattatttagaattgtttttgtattacatattcatgttaagaaccccgtcttcccttaaaatacattaaaattatgacatttttgctttgtgattgaatttcaaatagcagtatggtatccttttatctagttaatatatgaaagtggcttgaatatagtcaaatccattttaggtactctactgactttttccttcacttgccaagcccttttattgttcactgttagaaaaatagagaaggtgagacagctgggggaaaatgtggagtaaatgataatcaaatgttgaattctaaaagtctctacatttacctaggttggctttctcccccagttcagaagtttccagcttggccaatcatcagaatcacttgaggaacttagaaagaactccctggctgtagctcctatgtaggtttaggttgagactctggattccacaatttttaaaggttaccatctgaggtttctgatcatagtctacttttgaagcagctgctgctgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaatttattaatacttttaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgtatttatgagctcattttcaaaatagtaagtttgtcatctttaaaatgaacatgacttgcctccttgatttctgaaatgaattaattgaagattgctatagtaatctttatttcatctttctagagttgttgacaattttattatacaacagttaccattagagaaggagggaagggctttgggtgtgtatttataggtactaagggatttactaaatatagtagattagcactgtcacacttgttcaagtagtttcaaacatagaaaattaagtatcaggtatgtggagcaatgtagtttttttttttcttcagtttaaaaaatttttaattgtggtagaagcaatgtattcttaaggtgaaaaacctacctcggttacatgtggtttgtgttttttggattaatctggattttataattagaaataaaaatgtaagattttgaatccaaaaaaaaaaaaaaaaaaaaaaaaaaaaaaaaaaaaaaaaaaaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgaaaaaaaaaaa

SEQ ID NO: 355745 - DNA, 8686 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaatattgaaaaattgaatcactttaactcctgaaaaacatacaattgtaatttcaatgtaaaatttcttatgtaggtactacctttttttatcgttccaaggtttgctagtgaacacaggatattttaaaagttttttattcttcgggcctggaaagtgtacaaagtcagtgtaggagaaaaaaatccatatttttatattagcatgcacactaaaaaccaaaatattattcatacttaaaacattcatacaaaacaatatgtaagcagaaatagtactaaaatactttgcctaatttctaagttgaagaataacactgggacacagttttttcatatgagagaatattccgctatttcaaatttaagggattttcttcctaacattgaaattttaaaaacagagttacttctaaataattatacagattttttcttctattaaatattattatttagaattgtttttgtattacatattcatgttaagaaccccgtcttcccttaaaatacattaaaattatgacatttttgctttgtgattgaatttcaaatagcagtatggtatccttttatctagttaatatatgaaagtggcttgaatatagtcaaatccattttaggtactctactgactttttccttcacttgccaagcccttttattgttcactgttagaaaaatagagaaggtgagacagctgggggaaaatgtggagtaaatgataatcaaatgttgaattctaaaagtctctacatttacctaggttggctttctcccccagttcagaagtttccagcttggccaatcatcagaatcacttgaggaacttagaaagaactccctggctgtagctcctatgtaggtttaggttgagactctggattccacaatttttaaaggttaccatctgaggtttctgatcatagtctacttttgaagcagctgctgctgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaatttattaatacttttaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgtatttatgagctcattttcaaaatagtaagtttgtcatctttaaaatgaacatgacttgcctccttgatttctgaaatgaattaattgaagattgctatagtaatctttatttcatctttctagagttgttgacaattttattatacaacagttaccattagagaaggagggaagggctttgggtgtgtatttataggtactaagggatttactaaatatagtagattagcactgtcacacttgttcaagtagtttcaaacatagaaaattaagtatcaggtatgtggagcaatgtagtttttttttttcttcagtttaaaaaatttttaattgtggtagaagcaatgtattcttaaggtgaaaaacctacctcggttacatgtggtttgtgttttttggattaatctggattttataattagaaataaaaatgtaagattttgaatccaaaaaaaaaaaaaaaaaaaaaaaaaaaaaaaaaaaaaaaaaaaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgaaaaaaaaaaa

SEQ ID NO: 355746 - DNA, 8762 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagaggacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaatattgaaaaattgaatcactttaactcctgaaaaacatacaattgtaatttcaatgtaaaatttcttatgtaggtactacctttttttatcgttccaaggtttgctagtgaacacaggatattttaaaagttttttattcttcgggcctggaaagtgtacaaagtcagtgtaggagaaaaaaatccatatttttatattagcatgcacactaaaaaccaaaatattattcatacttaaaacattcatacaaaacaatatgtaagcagaaatagtactaaaatactttgcctaatttctaagttgaagaataacactgggacacagttttttcatatgagagaatattccgctatttcaaatttaagggattttcttcctaacattgaaattttaaaaacagagttacttctaaataattatacagattttttcttctattaaatattattatttagaattgtttttgtattacatattcatgttaagaaccccgtcttcccttaaaatacattaaaattatgacatttttgctttgtgattgaatttcaaatagcagtatggtatccttttatctagttaatatatgaaagtggcttgaatatagtcaaatccattttaggtactctactgactttttccttcacttgccaagcccttttattgttcactgttagaaaaatagagaaggtgagacagctgggggaaaatgtggagtaaatgataatcaaatgttgaattctaaaagtctctacatttacctaggttggctttctcccccagttcagaagtttccagcttggccaatcatcagaatcacttgaggaacttagaaagaactccctggctgtagctcctatgtaggtttaggttgagactctggattccacaatttttaaaggttaccatctgaggtttctgatcatagtctacttttgaagcagctgctgctgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaatttattaatacttttaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgtatttatgagctcattttcaaaatagtaagtttgtcatctttaaaatgaacatgacttgcctccttgatttctgaaatgaattaattgaagattgctatagtaatctttatttcatctttctagagttgttgacaattttattatacaacagttaccattagagaaggagggaagggctttgggtgtgtatttataggtactaagggatttactaaatatagtagattagcactgtcacacttgttcaagtagtttcaaacatagaaaattaagtatcaggtatgtggagcaatgtagtttttttttttcttcagtttaaaaaatttttaattgtggtagaagcaatgtattcttaaggtgaaaaacctacctcggttacatgtggtttgtgttttttggattaatctggattttataattagaaataaaaatgtaagattttgaatccaaaaaaaaaaaaaaaaaaaaaaaaaaaaaaaaaaaaaaaaaaaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgaaaaaaaaaaa

SEQ ID NO: 355747 - DNA, 9439 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaatattgaaaaattgaatcactttaactcctgaaaaacatacaattgtaatttcaatgtaaaatttcttatgtaggtactacctttttttatcgttccaaggtttgctagtgaacacaggatattttaaaagttttttattcttcgggcctggaaagtgtacaaagtcagtgtaggagaaaaaaatccatatttttatattagcatgcacactaaaaaccaaaatattattcatacttaaaacattcatacaaaacaatatgtaagcagaaatagtactaaaatactttgcctaatttctaagttgaagaataacactgggacacagttttttcatatgagagaatattccgctatttcaaatttaagggattttcttcctaacattgaaattttaaaaacagagttacttctaaataattatacagattttttcttctattaaatattattatttagaattgtttttgtattacatattcatgttaagaaccccgtcttcccttaaaatacattaaaattatgacatttttgctttgtgattgaatttcaaatagcagtatggtatccttttatctagttaatatatgaaagtggcttgaatatagtcaaatccattttaggtactctactgactttttccttcacttgccaagcccttttattgttcactgttagaaaaatagagaaggtgagacagctgggggaaaatgtggagtaaatgataatcaaatgttgaattctaaaagtctctacatttacctaggttggctttctcccccagttcagaagtttccagcttggccaatcatcagaatcacttgaggaacttagaaagaactccctggctgtagctcctatgtaggtttaggttgagactctggattccacaatttttaaaggttaccatctgaggtttctgatcatagtctacttttgaagcagctgctgctgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaatttattaatacttttaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgtatttatgagctcattttcaaaatagtaagtttgtcatctttaaaatgaacatgacttgcctccttgatttctgaaatgaattaattgaagattgctatagtaatctttatttcatctttctagagttgttgacaattttattatacaacagttaccattagagaaggagggaagggctttgggtgtgtatttataggtactaagggatttactaaatatagtagattagcactgtcacacttgttcaagtagtttcaaacatagaaaattaagtatcaggtatgtggagcaatgtagtttttttttttcttcagtttaaaaaatttttaattgtggtagaagcaatgtattcttaaggtgaaaaacctacctcggttacatgtggtttgtgttttttggattaatctggattttataattagaaataaaaatgtaagattttgaatccacttaatttcttgaaaatagtacaagtcagtgtaatagagaagcattcatatattcaacactgtaagacaaaacagcagagaccttggatttgataattgatctgatatcctggacagtattcatatgtacagtgataggtatctttctttggagttttttttttgtgcatatgtgtatagttttatgggttctgagttggtgaccagtaagttgcatgtagtgctggcacttacttaataactattcatgatattgttaataacttgttataggattgtattcccaattacagtctctaagattgtaattgatattatctgagaggtagtgtgacaactttcttttgttgttacattaagccgaaaacataatactaatagacaactaacagtttgcttatcaggcacatcaactaaggcacctccccccatgctaagtttctcctggatatatggaagttgattgtttcccagtttaaaaacttgaactaatatctcctaagaaaatctgagtccatatggtttttattttacttagctagaatctcatagcatgttaaagtcatatccttatccccactaaaaataactatgtctatgtgagaggaatatagtatgtgggagctgtattaaatactattacaggtgttacagaatctttaaataaatggacatggaccaactttccatctagtagtgtacgatctatatagtgcatgtcagtagcacaaaatgcagtcttagcattagcctgtctaatctgaatagtttactcaaaagtacttctttgtgttaagtattcagccactgtttttagatctagttaataggttctatttaatttgctacaacatttactgaatggtggagtgaaaaaactgatgcatactgggaaatatctaccattttttaaagataatgttaattaggaaaagaacacttttaaggaatttatagcagtgatgaaatgaattcagttatatcagatacaccaaactgttgatggtatttaaatgtgacttcaagttagtatttctgtatatattattgattactggtttgtttttagatatgtaagtctgttctaatctacagttcacatatcgacagttactctggtaataatagaatgttagtgatgatcacttggtggatgttgattaagtgcctgtgttttgtttcctcctctggataccaaataggtgtatgctacttttttggtgaacttatttcttggaagatttggctatgctattcagggtttttattcttatgtttttcttctaaatttaagtagcatcctgctgctaccatattaaagctaaaatttaacttttgctgaagaatcagctaattcaggtaatccaaatatttgtggaaaaacatctggataatttattgaacacattagtattgtgttagctttgatcattcccatttcataggtttttattgtggaatagtcaacttaatatagattcactttcaatttgcatgtataaagtaatactcaataaaatttttttcatttatttttcaaaagtgg

SEQ ID NO: 355748 - DNA, 8721 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaactagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaatattgaaaaattgaatcactttaactcctgaaaaacatacaattgtaatttcaatgtaaaatttcttatgtaggtactacctttttttatcgttccaaggtttgctagtgaacacaggatattttaaaagttttttattcttcgggcctggaaagtgtacaaagtcagtgtaggagaaaaaaatccatatttttatattagcatgcacactaaaaaccaaaatattattcatacttaaaacattcatacaaaacaatatgtaagcagaaatagtactaaaatactttgcctaatttctaagttgaagaataacactgggacacagttttttcatatgagagaatattccgctatttcaaatttaagggattttcttcctaacattgaaattttaaaaacagagttacttctaaataattatacagattttttcttctattaaatattattatttagaattgtttttgtattacatattcatgttaagaaccccgtcttcccttaaaatacattaaaattatgacatttttgctttgtgattgaatttcaaatagcagtatggtatccttttatctagttaatatatgaaagtggcttgaatatagtcaaatccattttaggtactctactgactttttccttcacttgccaagcccttttattgttcactgttagaaaaatagagaaggtgagacagctgggggaaaatgtggagtaaatgataatcaaatgttgaattctaaaagtctctacatttacctaggttggctttctcccccagttcagaagtttccagcttggccaatcatcagaatcacttgaggaacttagaaagaactccctggctgtagctcctatgtaggtttaggttgagactctggattccacaatttttaaaggttaccatctgaggtttctgatcatagtctacttttgaagcagctgctgctgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaatttattaatacttttaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgtatttatgagctcattttcaaaatagtaagtttgtcatctttaaaatgaacatgacttgcctccttgatttctgaaatgaattaattgaagattgctatagtaatctttatttcatctttctagagttgttgacaattttattatacaacagttaccattagagaaggagggaagggctttgggtgtgtatttataggtactaagggatttactaaatatagtagattagcactgtcacacttgttcaagtagtttcaaacatagaaaattaagtatcaggtatgtggagcaatgtagtttttttttttcttcagtttaaaaaatttttaattgtggtagaagcaatgtattcttaaggtgaaaaacctacctcggttacatgtggtttgtgttttttggattaatctggattttataattagaaataaaaatgtaagattttgaatccaaaaaaaaaaaaaaaaaaaaaaaaaaaaaaaaaaaaaaaaaaaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgaaaaaaaaaaa

SEQ ID NO: 355749 - DNA, 8834 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagaggatagccgtcttctggaaaaatctttgtatacatttacaaatcctgtacttctcctgctttgtttttatagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaatattgaaaaattgaatcactttaactcctgaaaaacatacaattgtaatttcaatgtaaaatttcttatgtaggtactacctttttttatcgttccaaggtttgctagtgaacacaggatattttaaaagttttttattcttcgggcctggaaagtgtacaaagtcagtgtaggagaaaaaaatccatatttttatattagcatgcacactaaaaaccaaaatattattcatacttaaaacattcatacaaaacaatatgtaagcagaaatagtactaaaatactttgcctaatttctaagttgaagaataacactgggacacagttttttcatatgagagaatattccgctatttcaaatttaagggattttcttcctaacattgaaattttaaaaacagagttacttctaaataattatacagattttttcttctattaaatattattatttagaattgtttttgtattacatattcatgttaagaaccccgtcttcccttaaaatacattaaaattatgacatttttgctttgtgattgaatttcaaatagcagtatggtatccttttatctagttaatatatgaaagtggcttgaatatagtcaaatccattttaggtactctactgactttttccttcacttgccaagcccttttattgttcactgttagaaaaatagagaaggtgagacagctgggggaaaatgtggagtaaatgataatcaaatgttgaattctaaaagtctctacatttacctaggttggctttctcccccagttcagaagtttccagcttggccaatcatcagaatcacttgaggaacttagaaagaactccctggctgtagctcctatgtaggtttaggttgagactctggattccacaatttttaaaggttaccatctgaggtttctgatcatagtctacttttgaagcagctgctgctgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaatttattaatacttttaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgtatttatgagctcattttcaaaatagtaagtttgtcatctttaaaatgaacatgacttgcctccttgatttctgaaatgaattaattgaagattgctatagtaatctttatttcatctttctagagttgttgacaattttattatacaacagttaccattagagaaggagggaagggctttgggtgtgtatttataggtactaagggatttactaaatatagtagattagcactgtcacacttgttcaagtagtttcaaacatagaaaattaagtatcaggtatgtggagcaatgtagtttttttttttcttcagtttaaaaaatttttaattgtggtagaagcaatgtattcttaaggtgaaaaacctacctcggttacatgtggtttgtgttttttggattaatctggattttataattagaaataaaaatgtaagattttgaatccaaaaaaaaaaaaaaaaaaaaaaaaaaaaaaaaaaaaaaaaaaaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgaaaaaaaaaaa

SEQ ID NO: 355750 - DNA, 8593 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaatattgaaaaattgaatcactttaactcctgaaaaacatacaattgtaatttcaatgtaaaatttcttatgtaggtactacctttttttatcgttccaaggtttgctagtgaacacaggatattttaaaagttttttattcttcgggcctggaaagtgtacaaagtcagtgtaggagaaaaaaatccatatttttatattagcatgcacactaaaaaccaaaatattattcatacttaaaacattcatacaaaacaatatgtaagcagaaatagtactaaaatactttgcctaatttctaagttgaagaataacactgggacacagttttttcatatgagagaatattccgctatttcaaatttaagggattttcttcctaacattgaaattttaaaaacagagttacttctaaataattatacagattttttcttctattaaatattattatttagaattgtttttgtattacatattcatgttaagaaccccgtcttcccttaaaatacattaaaattatgacatttttgctttgtgattgaatttcaaatagcagtatggtatccttttatctagttaatatatgaaagtggcttgaatatagtcaaatccattttaggtactctactgactttttccttcacttgccaagcccttttattgttcactgttagaaaaatagagaaggtgagacagctgggggaaaatgtggagtaaatgataatcaaatgttgaattctaaaagtctctacatttacctaggttggctttctcccccagttcagaagtttccagcttggccaatcatcagaatcacttgaggaacttagaaagaactccctggctgtagctcctatgtaggtttaggttgagactctggattccacaatttttaaaggttaccatctgaggtttctgatcatagtctacttttgaagcagctgctgctgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaatttattaatacttttaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgtatttatgagctcattttcaaaatagtaagtttgtcatctttaaaatgaacatgacttgcctccttgatttctgaaatgaattaattgaagattgctatagtaatctttatttcatctttctagagttgttgacaattttattatacaacagttaccattagagaaggagggaagggctttgggtgtgtatttataggtactaagggatttactaaatatagtagattagcactgtcacacttgttcaagtagtttcaaacatagaaaattaagtatcaggtatgtggagcaatgtagtttttttttttcttcagtttaaaaaatttttaattgtggtagaagcaatgtattcttaaggtgaaaaacctacctcggttacatgtggtttgtgttttttggattaatctggattttataattagaaataaaaatgtaagattttgaatccaaaaaaaaaaaaaaaaaaaaaaaaaaaaaaaaaaaaaaaaaaaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgaaaaaaaaaaa

SEQ ID NO: 355751 - DNA, 8595 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaattcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaatattgaaaaattgaatcactttaactcctgaaaaacatacaattgtaatttcaatgtaaaatttcttatgtaggtactacctttttttatcgttccaaggtttgctagtgaacacaggatattttaaaagttttttattcttcgggcctggaaagtgtacaaagtcagtgtaggagaaaaaaatccatatttttatattagcatgcacactaaaaaccaaaatattattcatacttaaaacattcatacaaaacaatatgtaagcagaaatagtactaaaatactttgcctaatttctaagttgaagaataacactgggacacagttttttcatatgagagaatattccgctatttcaaatttaagggattttcttcctaacattgaaattttaaaaacagagttacttctaaataattatacagattttttcttctattaaatattattatttagaattgtttttgtattacatattcatgttaagaaccccgtcttcccttaaaatacattaaaattatgacatttttgctttgtgattgaatttcaaatagcagtatggtatccttttatctagttaatatatgaaagtggcttgaatatagtcaaatccattttaggtactctactgactttttccttcacttgccaagcccttttattgttcactgttagaaaaatagagaaggtgagacagctgggggaaaatgtggagtaaatgataatcaaatgttgaattctaaaagtctctacatttacctaggttggctttctcccccagttcagaagtttccagcttggccaatcatcagaatcacttgaggaacttagaaagaactccctggctgtagctcctatgtaggtttaggttgagactctggattccacaatttttaaaggttaccatctgaggtttctgatcatagtctacttttgaagcagctgctgctgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaatttattaatacttttaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgtatttatgagctcattttcaaaatagtaagtttgtcatctttaaaatgaacatgacttgcctccttgatttctgaaatgaattaattgaagattgctatagtaatctttatttcatctttctagagttgttgacaattttattatacaacagttaccattagagaaggagggaagggctttgggtgtgtatttataggtactaagggatttactaaatatagtagattagcactgtcacacttgttcaagtagtttcaaacatagaaaattaagtatcaggtatgtggagcaatgtagtttttttttttcttcagtttaaaaaatttttaattgtggtagaagcaatgtattcttaaggtgaaaaacctacctcggttacatgtggtttgtgttttttggattaatctggattttataattagaaataaaaatgtaagattttgaatccaaaaaaaaaaaaaaaaaaaaaaaaaaaaaaaaaaaaaaaaaaaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgaaaaaaaaaaa

SEQ ID NO: 355752 - DNA, 9159 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcaggtaagtcacagatacattttgtgctcaggtctactgtgtgcttatgtatgtgcatgcgtttttgtttagaagattgtggggctctggattttttcatttatcttgttaaatttatttgcagaccaaaattggttcccaaatgaggcaattatgcatgtctgggggaaattttaagttcctgaactatgaactttccttgaattagactgcttaaaatgtaaatttctctctttgaccactctgggtgagctttttggttcataatttaaggatgtctcaccttgcgttttaaaaaaatccatccctgtagtcatgtgttttcagctgctagaaagtgctttcattgtttagctgttttccttttctctttttttgtgttgctgcttatgatgctatagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaatattgaaaaattgaatcactttaactcctgaaaaacatacaattgtaatttcaatgtaaaatttcttatgtaggtactacctttttttatcgttccaaggtttgctagtgaacacaggatattttaaaagttttttattcttcgggcctggaaagtgtacaaagtcagtgtaggagaaaaaaatccatatttttatattagcatgcacactaaaaaccaaaatattattcatacttaaaacattcatacaaaacaatatgtaagcagaaatagtactaaaatactttgcctaatttctaagttgaagaataacactgggacacagttttttcatatgagagaatattccgctatttcaaatttaagggattttcttcctaacattgaaattttaaaaacagagttacttctaaataattatacagattttttcttctattaaatattattatttagaattgtttttgtattacatattcatgttaagaaccccgtcttcccttaaaatacattaaaattatgacatttttgctttgtgattgaatttcaaatagcagtatggtatccttttatctagttaatatatgaaagtggcttgaatatagtcaaatccattttaggtactctactgactttttccttcacttgccaagcccttttattgttcactgttagaaaaatagagaaggtgagacagctgggggaaaatgtggagtaaatgataatcaaatgttgaattctaaaagtctctacatttacctaggttggctttctcccccagttcagaagtttccagcttggccaatcatcagaatcacttgaggaacttagaaagaactccctggctgtagctcctatgtaggtttaggttgagactctggattccacaatttttaaaggttaccatctgaggtttctgatcatagtctacttttgaagcagctgctgctgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaatttattaatacttttaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgtatttatgagctcattttcaaaatagtaagtttgtcatctttaaaatgaacatgacttgcctccttgatttctgaaatgaattaattgaagattgctatagtaatctttatttcatctttctagagttgttgacaattttattatacaacagttaccattagagaaggagggaagggctttgggtgtgtatttataggtactaagggatttactaaatatagtagattagcactgtcacacttgttcaagtagtttcaaacatagaaaattaagtatcaggtatgtggagcaatgtagtttttttttttcttcagtttaaaaaatttttaattgtggtagaagcaatgtattcttaaggtgaaaaacctacctcggttacatgtggtttgtgttttttggattaatctggattttataattagaaataaaaatgtaagattttgaatccaaaaaaaaaaaaaaaaaaaaaaaaaaaaaaaaaaaaaaaaaaaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgaaaaaaaaaaa

SEQ ID NO: 355753 - DNA, 8005 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaatattgaaaaattgaatcactttaactcctgaaaaacatacaattgtaatttcaatgtaaaatttcttatgtaggtactacctttttttatcgttccaaggtttgctagtgaacacaggatattttaaaagttttttattcttcgggcctggaaagtgtacaaagtcagtgtaggagaaaaaaatccatatttttatattagcatgcacactaaaaaccaaaatattattcatacttaaaacattcatacaaaacaatatgtaagcagaaatagtactaaaatactttgcctaatttctaagttgaagaataacactgggacacagttttttcatatgagagaatattccgctatttcaaatttaagggattttcttcctaacattgaaattttaaaaacagagttacttctaaataattatacagattttttcttctattaaatattattatttagaattgtttttgtattacatattcatgttaagaaccccgtcttcccttaaaatacattaaaattatgacatttttgctttgtgattgaatttcaaatagcagtatggtatccttttatctagttaatatatgaaagtggcttgaatatagtcaaatccattttaggtactctactgactttttccttcacttgccaagcccttttattgttcactgttagaaaaatagagaaggtgagacagctgggggaaaatgtggagtaaatgataatcaaatgttgaattctaaaagtctctacatttacctaggttggctttctcccccagttcagaagtttccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaatttattaatacttttaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgtatttatgagctcattttcaaaatagtaagtttgtcatctttaaaatgaacatgacttgcctccttgatttctgaaatgaattaattgaagattgctatagtaatctttatttcatctttctagagttgttgacaattttattatacaacagttaccattagagaaggagggaagggctttgggtgtgtatttataggtactaagggatttactaaatatagtagattagcactgtcacacttgttcaagtagtttcaaacatagaaaattaagtatcaggtatgtggagcaatgtagtttttttttttcttcagtttaaaaaatttttaattgtggtagaagcaatgtattcttaaggtgaaaaacctacctcggttacatgtggtttgtgttttttggattaatctggattttataattagaaataaaaatgtaagattttgaatccaaaaaaaaaaaaaaaaaaaaaaaaaaaaaaaaaaaaaaaaaaaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgaaaaaaaaaaa

SEQ ID NO: 355754 - DNA, 7445 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaatattgaaaaattgaatcactttaactcctgaaaaacatacaattgtaatttcaatgtaaaatttcttatgtaggtactacctttttttatcgttccaaggtttgctagtgaacacaggatattttaaaagttttttattcttcgggcctggaaagtgtacaaagtcagtgtaggagaaaaaaatccatatttttatattagcatgcacactaaaaaccaaaatattattcatacttaaaacattcatacaaaacaatatgtaagcagaaatagtactaaaatactttgcctaatttctaagttgaagaataacactgggacacagttttttcatatgagagaatattccgctatttcaaatttaagggattttcttcctaacattgaaattttaaaaacagagttacttctaaataattatacagattttttcttctattaaatattattatttagaattgtttttgtattacatattcatgttaagaaccccgtcttcccttaaaatacattaaaattatgacatttttgctttgtgattgaatttcaaatagcagtatggtatccttttatctagttaatatatgaaagtggcttgaatatagtcaaatccattttaggtactctactgactttttccttcacttgccaagcccttttattgttcactgttagaaaaatagagaaggtgagacagctgggggaaaatgtggagtaaatgataatcaaatgttgaattctaaaagtctctacatttacctaggttggctttctcccccagttcagaagtttccagcttggccaatcatcagaatcacttgaggaacttagaaagaactccctggctgtagctcctatgtaggtttaggttgagactctggattccacaatttttaaaggttaccatctgaggtttctgatcatagtctacttttgaagcagctgctgctgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaatttattaatacttttaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgta

SEQ ID NO: 355755 - DNA, 8416 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaatattgaaaaattgaatcactttaactcctgaaaaacatacaattgtaatttcaatgtaaaatttcttatgtaggtactacctttttttatcgttccaaggtttgctagtgaacacaggatattttaaaagttttttattcttcgggcctggaaagtgtacaaagtcagtgtaggagaaaaaaatccatatttttatattagcatgcacactaaaaaccaaaatattattcatacttaaaacattcatacaaaacaatatgtaagcagaaatagtactaaaatactttgcctaatttctaagttgaagaataacactgggacacagttttttcatatgagagaatattccgctatttcaaatttaagggattttcttcctaacattgaaattttaaaaacagagttacttctaaataattatacagattttttcttctattaaatattattatttagaattgtttttgtattacatattcatgttaagaaccccgtcttcccttaaaatacattaaaattatgacatttttgctttgtgattgaatttcaaatagcagtatggtatccttttatctagttaatatatgaaagtggcttgaatatagtcaaatccattttaggtactctactgactttttccttcacttgccaagcccttttattgttcactgttagaaaaatagagaaggtgagacagctgggggaaaatgtggagtaaatgataatcaaatgttgaattctaaaagtctctacatttacctaggttggctttctcccccagttcagaagtttccagcttggccaatcatcagaatcacttgaggaacttagaaagaactccctggctgtagctcctatgtaggtttaggttgagactctggattccacaatttttaaaggttaccatctgaggtttctgatcatagtctacttttgaagcagctgctgctgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaatttattaatacttttaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgtatttatgagctcattttcaaaatagtaagtttgtcatctttaaaatgaacatgacttgcctccttgatttctgaaatgaattaattgaagattgctatagtaatctttatttcatctttctagagttgttgacaattttattatacaacagttaccattagagaaggagggaagggctttgggtgtgtatttataggtactaagggatttactaaatatagtagattagcactgtcacacttgttcaagtagtttcaaacatagaaaattaagtatcaggtatgtggagcaatgtagtttttttttttcttcagtttaaaaaatttttaattgtggtagaagcaatgtattcttaaggtgaaaaacctacctcggttacatgtggtttgtgttttttggattaatctggattttataattagaaataaaaatgtaagattttgaatccaaaaaaaaaaaaaaaaaaaaaaaaaaaaaaaaaaaaaaaaaaaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgaaaaaaaaaaa

SEQ ID NO: 355756 - DNA, 8313 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaatattgaaaaattgaatcactttaactcctgaaaaacatacaattgtaatttcaatgtaaaatttcttatgtaggtactacctttttttatcgttccaaggtttgctagtgaacacaggatattttaaaagttttttattcttcgggcctggaaagtgtacaaagtcagtgtaggagaaaaaaatccatatttttatattagcatgcacactaaaaaccaaaatattattcatacttaaaacattcatacaaaacaatatgtaagcagaaatagtactaaaatactttgcctaatttctaagttgaagaataacactgggacacagttttttcatatgagagaatattccgctatttcaaatttaagggattttcttcctaacattgaaattttaaaaacagagttacttctaaataattatacagattttttcttctattaaatattattatttagaattgtttttgtattacatattcatgttaagaaccccgtcttcccttaaaatacattaaaattatgacatttttgctttgtgattgaatttcaaatagcagtatggtatccttttatctagttaatatatgaaagtggcttgaatatagtcaaatccattttaggtactctactgactttttccttcacttgccaagcccttttattgttcactgttagaaaaatagagaaggtgagacagctgggggaaaatgtggagtaaatgataatcaaatgttgaattctaaaagtctctacatttacctaggttggctttctcccccagttcagaagtttccagcttggccaatcatcagaatcacttgaggaacttagaaagaactccctggctgtagctcctatgtaggtttaggttgagactctggattccacaatttttaaaggttaccatctgaggtttctgatcatagtctacttttgaagcagctgctgctgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaatttattaatacttttaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgtatttatgagctcattttcaaaatagtaagtttgtcatctttaaaatgaacatgacttgcctccttgatttctgaaatgaattaattgaagattgctatagtaatctttatttcatctttctagagttgttgacaattttattatacaacagttaccattagagaaggagggaagggctttgggtgtgtatttataggtactaagggatttactaaatatagtagattagcactgtcacacttgttcaagtagtttcaaacatagaaaattaagtatcaggtatgtggagcaatgtagtttttttttttcttcagtttaaaaaatttttaattgtggtagaagcaatgtattcttaaggtgaaaaacctacctcggttacatgtggtttgtgttttttggattaatctggattttataattagaaataaaaatgtaagattttgaatccacttaatttcttgaaaatagtacaagtcagtgtaatagagaagcattcatatattcaacactgtaagacaaaacagcagagaccttggatttgataattgatctgatatcctggacagtattcatatgtacagtgataggtatctttctttggagttttttttttgtgcatatgtgtatagttttatgggttctgagttggtgaccagtaagttgcatgtagtgctggcacttacttaataactattcatgatattgttaataacttgttataggattgtattcccaattacagtctctaagattgtaattgatattatctgagaggtagtgtgacaactttcttttgttgttacattaagccgaaaacataatactaacttcacgactccgatttccagatttactgggatcctctagaa

SEQ ID NO: 355757 - DNA, 8568 bp, Homo sapiens
  misc_feature (8568)..(8568): n is a, c, g, or t
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaatattgaaaaattgaatcactttaactcctgaaaaacatacaattgtaatttcaatgtaaaatttcttatgtaggtactacctttttttatcgttccaaggtttgctagtgaacacaggatattttaaaagttttttattcttcgggcctggaaagtgtacaaagtcagtgtaggagaaaaaaatccatatttttatattagcatgcacactaaaaaccaaaatattattcatacttaaaacattcatacaaaacaatatgtaagcagaaatagtactaaaatactttgcctaatttctaagttgaagaataacactgggacacagttttttcatatgagagaatattccgctatttcaaatttaagggattttcttcctaacattgaaattttaaaaacagagttacttctaaataattatacagattttttcttctattaaatattattatttagaattgtttttgtattacatattcatgttaagaaccccgtcttcccttaaaatacattaaaattatgacatttttgctttgtgattgaatttcaaatagcagtatggtatccttttatctagttaatatatgaaagtggcttgaatatagtcaaatccattttaggtactctactgactttttccttcacttgccaagcccttttattgttcactgttagaaaaatagagaaggtgagacagctgggggaaaatgtggagtaaatgataatcaaatgttgaattctaaaagtctctacatttacctaggttggctttctcccccagttcagaagtttccagcttggccaatcatcagaatcacttgaggaacttagaaagaactccctggctgtagctcctatgtaggtttaggttgagactctggattccacaatttttaaaggttaccatctgaggtttctgatcatagtctacttttgaagcagctgctgctgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaatttattaatacttttaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgtatttatgagctcattttcaaaatagtaagtttgtcatctttaaaatgaacatgacttgcctccttgatttctgaaatgaattaattgaagattgctatagtaatctttatttcatctttctagagttgttgacaattttattatacaacagttaccattagagaaggagggaagggctttgggtgtgtatttataggtactaagggatttactaaatatagtagattagcactgtcacacttgttcaagtagtttcaaacatagaaaattaagtatcaggtatgtggagcaatgtagtttttttttttcttcagtttaaaaaatttttaattgtggtagaagcaatgtattcttaaggtgaaaaacctacctcggttacatgtggtttgtgttttttggattaatctggattttataattagaaataaaaatgtaagattttgaatccaaaaaaaaaaaaaaaaaaaaaaaaaaaaaaaaaaaaaaaaaatcccgaaaattttccccggggggccgggggtggccgcgcgcgtgggagtgtggggcgcccggggaacccggttaggagaccgagccatcagatttcaccagggggagaacctggtagaggaagacagggcggagggagagtagaccaatctggcagcgatggggggggggctgcgccgttaagaccccggagggcgccgcaaagctgtggagaccccgcgaggcagctcggggcaggtagtggggcccccgagggagcgacgggcacttttacccgggagcacaccacacgcctggtgtggggcgacgggagcgcaccaaagaaatggggggcatgagagacgcatggggtcgctagagcaagcgcgggagagcacccggcacgcccagagcagaggaaataaaaaagacgcctctcggggggagaaaacgccgcgggggaacaggccaagaaaaattcgccccccaacgaaaaggaggggggcgcccagacagcgagaccgggagaccctcggggagaaaaatattttcccccctccacaaacgccgggtgtggcacaaaacccgcattcgccaaataatacactaccccacctacagaagaggagggagatcaccccgggcccacggcggcn

SEQ ID NO: 355758 - DNA, 8386 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaatattgaaaaattgaatcactttaactcctgaaaaacatacaattgtaatttcaatgtaaaatttcttatgtaggtactacctttttttatcgttccaaggtttgctagtgaacacaggatattttaaaagttttttattcttcgggcctggaaagtgtacaaagtcagtgtaggagaaaaaaatccatatttttatattagcatgcacactaaaaaccaaaatattattcatacttaaaacattcatacaaaacaatatgtaagcagaaatagtactaaaatactttgcctaatttctaagttgaagaataacactgggacacagttttttcatatgagagaatattccgctatttcaaatttaagggattttcttcctaacattgaaattttaaaaacagagttacttctaaataattatacagattttttcttctattaaatattattatttagaattgtttttgtattacatattcatgttaagaaccccgtcttcccttaaaatacattaaaattatgacatttttgctttgtgattgaatttcaaatagcagtatggtatccttttatctagttaatatatgaaagtggcttgaatatagtcaaatccattttaggtactctactgactttttccttcacttgccaagcccttttattgttcactgttagaaaaatagagaaggtgagacagctgggggaaaatgtggagtaaatgataatcaaatgttgaattctaaaagtctctacatttacctaggttggctttctcccccagttcagaagtttccagcttggccaatcatcagaatcacttgaggaacttagaaagaactccctggctgtagctcctatgtaggtttaggttgagactctggattccacaatttttaaaggttaccatctgaggtttctgatcatagtctacttttgaagcagctgctgctgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaatttattaatacttttaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgtatttatgagctcattttcaaaatagtaagtttgtcatctttaaaatgaacatgacttgcctccttgatttctgaaatgaattaattgaagattgctatagtaatctttatttcatctttctagagttgttgacaattttattatacaacagttaccattagagaaggagggaagggctttgggtgtgtatttataggtactaagggatttactaaatatagtagattagcactgtcacacttgttcaagtagtttcaaacatagaaaattaagtatcaggtatgtggagcaatgtagtttttttttttcttcagtttaaaaaatttttaattgtggtagaagcaatgtattcttaaggtgaaaaacctacctcggttacatgtggtttgtgttttttggattaatctggattttataattagaaataaaaatgtaagattttgaatccaaaaaaaaaaaaaaaaaaaaaaaaaaaaaaaaaaaaaaaaaactgcaaaattgtgtttctcccggggggcccgggggtgtgcgcgggcgttgggccccggaagcgtatggaacacgcattgcgtttcccgggggcgaagcggctgtgcgaacgatagagagcgaggaaaaacacattttggcccggctgggtttagggagtccagcttgaactcggagaggacacacacagctgtggaaccacggaagaaggccatgaggaggagattaggggcgcacaggaggcgacaggaccatataccccggatgcaccagcgtctggtggaggatcgaccaccccggaagagggggcattagcagaggccctaagaacacgagagacggatcacggacgaattaaaagcctccggcgcgacccggaggaggtggcaaaaatgcccccacaaaggagggtgccacatccggcccggacctggaaaatatcccctcacaccg

SEQ ID NO: 355759 - DNA, 5474 bp, Homo sapiens
gtgcgtgggagaaactttgcagggtggggacccggcggctgctggccggtagtgactggtgggcgcgctcgaggactccaaggggcgcagcccgggggcagacccttgggtcgggcggggatcttacgcttcccttacccgcccccttttgtctttcacctcagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaatattgaaaaattgaatcactttaactcctgaaaaacatacaattgtaatttcaatgtaaaatttcttatgtaggtactacctttttttatcgttccaaggtttgctagtgaacacaggatattttaaaagttttttattcttcgggcctggaaagtgtacaaagtcagtgtaggagaaaaaaatccatatttttatattagcatgcacactaaaaaccaaaatattattcatacttaaaacattcatacaaaacaatatgtaagcagaaatagtactaaaatactttgcctaatttctaagttgaagaataacactgggacacagttttttcatatgagagaatattccgctatttcaaatttaagggattttcttcctaacattgaaattttaaaaacagagttacttctaaataattatacagattttttcttctattaaatattattatttagaattgtttttgtattacatattcatgttaagaaccccgtcttcccttaaaatacattaaaattatgacatttttgctttgtgattgaatttcaaatagcagtatggtatccttttatctagttaatatatgaaagtggcttgaatatagtcaaatccattttaggtactctactgactttttccttcacttgccaagcccttttattgttcactgttagaaaaatagagaaggtgagacagctgggggaaaatgtggagtaaatgataatcaaatgttgaattctaaaagtctctacatttacctaggttggctttctcccccagttcagaagtttccagcttggccaatcatcagaatcacttgaggaacttagaaagaactccctggctgtagctcctatgtaggtttaggttgagactctggattccacaatttttaaaggttaccatctgaggtttctgatcatagtctacttttgaagcagctgctgctgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaatttattaatacttttaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgtatttatgagctcattttcaaaatagtaagtttgtcatctttaaaatgaacatgacttgcctccttgatttctgaaatgaattaattgaagattgctatagtaatctttatttcatctttctagagttgttgacaattttattatacaacagttaccattagagaaggagggaagggctttgggtgtgtatttataggtactaagggatttactaaatatagtagattagcactgtcacacttgttcaagtagtttcaaacatagaaaattaagtatcaggtatgtggagcaatgtagtttttttttttcttcagtttaaaaaatttttaattgtggtagaagcaatgtattcttaaggtgaaaaacctacctcggttacatgtggtttgtgttttttggattaatctggattttataattagaaataaaaatgtaagattttgaatccaaaaaaaaaaaaaaaaaaaaaaaaaaaaaaaaaaaaaaaaaaaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgaaaaaaaaaaa

SEQ ID NO: 355760 - DNA, 6304 bp, Homo sapiens
ggtgcttttccatcccttaaagccaagcttatatatcaggatttcatcagctttgagctggtcagatagtacaggaagtggaaaaaatgaaaggcctgagctcaccagcagaagaaagctgtacagctagaatttcttataagtgaaagtggatgtgaaccaattgtggagcatggatgattggaaaagaaacctagagtgtgagccaagaccaagatagctgtgggagaagataaaaaggccagtttactggtctggctgcatggatacagagtcattcaacctgctgatgaatatatttcaatcaaggtcctggaatctgaccattctgattagccactcctgatggtgtaggaaaggaaagaatttgagcttcagaaggaaagctacagtttttttttgtttttcttccacatactcactcaccctcacgcccagctaaactatgaaagttcctggggaaaagtgatagagaacataaaatgagagctctggttaccattctatttctaaacattcattgcactctttattattttaatacaaatcctgttttctctttgctttactcacgaacctgtgttttactccacttgaatattgtgatttaatacctattaaaagagaattactgtggtcacccctgaacttttttgcacttatctcttttataatttcttactttgttgcagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaatattgaaaaattgaatcactttaactcctgaaaaacatacaattgtaatttcaatgtaaaatttcttatgtaggtactacctttttttatcgttccaaggtttgctagtgaacacaggatattttaaaagttttttattcttcgggcctggaaagtgtacaaagtcagtgtaggagaaaaaaatccatatttttatattagcatgcacactaaaaaccaaaatattattcatacttaaaacattcatacaaaacaatatgtaagcagaaatagtactaaaatactttgcctaatttctaagttgaagaataacactgggacacagttttttcatatgagagaatattccgctatttcaaatttaagggattttcttcctaacattgaaattttaaaaacagagttacttctaaataattatacagattttttcttctattaaatattattatttagaattgtttttgtattacatattcatgttaagaaccccgtcttcccttaaaatacattaaaattatgacatttttgctttgtgattgaatttcaaatagcagtatggtatccttttatctagttaatatatgaaagtggcttgaatatagtcaaatccattttaggtactctactgactttttccttcacttgccaagcccttttattgttcactgttagaaaaatagagaaggtgagacagctgggggaaaatgtggagtaaatgataatcaaatgttgaattctaaaagtctctacatttacctaggttggctttctcccccagttcagaagtttccagcttggccaatcatcagaatcacttgaggaacttagaaagaactccctggctgtagctcctatgtaggtttaggttgagactctggattccacaatttttaaaggttaccatctgaggtttctgatcatagtctacttttgaagcagctgctgctgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaatttattaatacttttaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgtatttatgagctcattttcaaaatagtaagtttgtcatctttaaaatgaacatgacttgcctccttgatttctgaaatgaattaattgaagattgctatagtaatctttatttcatctttctagagttgttgacaattttattatacaacagttaccattagagaaggagggaagggctttgggtgtgtatttataggtactaagggatttactaaatatagtagattagcactgtcacacttgttcaagtagtttcaaacatagaaaattaagtatcaggtatgtggagcaatgtagtttttttttttcttcagtttaaaaaatttttaattgtggtagaagcaatgtattcttaaggtgaaaaacctacctcggttacatgtggtttgtgttttttggattaatctggattttataattagaaataaaaatgtaagattttgaatccaaaaaaaaaaaaaaaaaaaaaaaaaaaaaaaaaaaaaaaaaaaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgaaaaaaaaaaa

SEQ ID NO: 355761 - DNA, 5336 bp, Homo sapiens
gcgatcgtcggggtccgtactgtaagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaatattgaaaaattgaatcactttaactcctgaaaaacatacaattgtaatttcaatgtaaaatttcttatgtaggtactacctttttttatcgttccaaggtttgctagtgaacacaggatattttaaaagttttttattcttcgggcctggaaagtgtacaaagtcagtgtaggagaaaaaaatccatatttttatattagcatgcacactaaaaaccaaaatattattcatacttaaaacattcatacaaaacaatatgtaagcagaaatagtactaaaatactttgcctaatttctaagttgaagaataacactgggacacagttttttcatatgagagaatattccgctatttcaaatttaagggattttcttcctaacattgaaattttaaaaacagagttacttctaaataattatacagattttttcttctattaaatattattatttagaattgtttttgtattacatattcatgttaagaaccccgtcttcccttaaaatacattaaaattatgacatttttgctttgtgattgaatttcaaatagcagtatggtatccttttatctagttaatatatgaaagtggcttgaatatagtcaaatccattttaggtactctactgactttttccttcacttgccaagcccttttattgttcactgttagaaaaatagagaaggtgagacagctgggggaaaatgtggagtaaatgataatcaaatgttgaattctaaaagtctctacatttacctaggttggctttctcccccagttcagaagtttccagcttggccaatcatcagaatcacttgaggaacttagaaagaactccctggctgtagctcctatgtaggtttaggttgagactctggattccacaatttttaaaggttaccatctgaggtttctgatcatagtctacttttgaagcagctgctgctgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaatttattaatacttttaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgtatttatgagctcattttcaaaatagtaagtttgtcatctttaaaatgaacatgacttgcctccttgatttctgaaatgaattaattgaagattgctatagtaatctttatttcatctttctagagttgttgacaattttattatacaacagttaccattagagaaggagggaagggctttgggtgtgtatttataggtactaagggatttactaaatatagtagattagcactgtcacacttgttcaagtagtttcaaacatagaaaattaagtatcaggtatgtggagcaatgtagtttttttttttcttcagtttaaaaaatttttaattgtggtagaagcaatgtattcttaaggtgaaaaacctacctcggttacatgtggtttgtgttttttggattaatctggattttataattagaaataaaaatgtaagattttgaatccaaaaaaaaaaaaaaaaaaaaaaaaaaaaaaaaaaaaaaaaaaaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgaaaaaaaaaaa

SEQ ID NO: 355762 - DNA, 5008 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccagctcctgatctttgttggttatgttgcaaaagattgtatcaggagaagcctcagcatggacattggcatcctgacataacccccattaatttagtattctttctgaaactcaaatggattctcaagtccaagagactatggaataaaatcattgtttgtctgtgttaagttttatctctgttattgcctgaagacttttggtaacaataatgcgctttcatcaaacttttaagacttgattggaaaaaataaatgtatgtttcatcagttatacaatttgttttgtatgtgttttgtatgggtggtccctgaggagcctgaatcttcaaaatatactttctgtgagctcagaaaatgaatagcacttttgagctaattgatcagtgtggaga

SEQ ID NO: 355763 - DNA, 5009 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagaggacctagatgacatagaagatgaaaatgaacagctaaagcaggaaaataaaactcttttgaaagttgtgggtcagctgaccagctcctgatctttgttggttatgttgcaaaagattgtatcaggagaagcctcagcatggacattggcatcctgacataacccccattaatttagtattctttctgaaactcaaatggattctcaagtccaagagactatggaataaaatcattgtttgtctgtgttaagttttatctctgttattgcctgaagacttttggtaacaataatgcgctttcatcaaacttttaagacttgattggaaaaaataaatgtatgtttcatcagttatacaatttgttttgtatgtgttttgtatgggtggtccctgaggagcctgaatcttcaaaatatactttctgtgagctcagaaaatgaatagcacttttgagctaattgatcagtgtggaga

SEQ ID NO: 355764 - DNA, 3458 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaaatgttaccagacctaaaagcagacaaccagaggctaaaggatgaaaatggggccttgatcagagttataagcaaactttccaaataaaaaaaaaaaaaaaacttcaagggggggcccggtccccaaattggccttttgggaggccgattacaatttaactggccgttgtttttacaacgtctggaactgggaaaacctgtggggtaccca

SEQ ID NO: 355765 - DNA, 4509 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttctctaaataactaaaccggaattctgaagctgaagaatacagtaactgaccttgcaaaaaaaaaattataggggatcacagcagactttattaagcaagagaaagaatcagcaaactcaagacaggtcattgaaattattgagacaaaggaatcaccggtaccgg

SEQ ID NO: 355766 - DNA, 4745 bp, Homo sapiens
gaaagagcggaaacgagaagatgcaattacacaacagaacactatgcagaatgaagctgtaaacttactagatccaggcagttcctatctgctacagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagaggacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaatattgaaaaattgaatcactttaactcctgaaaaacatacaattgtaatttcaatgtaaaatttcttatgtaggtactacctttttttatcgttccaaggtttgctagtgaacacaggatattttaaaagttttttattcttcgggcctggaaagtgtacaaagtcagtgtaggagaaaaaaatccatatttttatattagcatgcacactaaaaaccaaaatattattcatacttaaaacattcatacaaaacaatatgtaagcagaaatagtactaaaatactttgcctaatttctaagttgaagaataacactgggacacagttttttcatatgagagaatattccgctatttcaaatttaagggattttcttcctaacattgaaattttaaaaacagagttacttctaaataattatacagattttttcttctattaaatattattatttagaattgtttttgtattacatattcatgttaagaaccccgtcttcccttaaaatacattaaaattatgacatttttgctttgtgattgaatttcaaatagcagtatggtatccttttatctagttaatatatgaaagtggcttgaatatagtcaaatccattttaggtactctactgactttttccttcacttgccaagcccttttattgttcactgttagaaaaatagagaaggtgagacagctgggggaaaatgtggagtaaatgataatcaaatgttgaattctaaaagtctctacatttacctaggttggctttctcccccagttcagaagtttccagcttggccaatcatcagaatcacttgaggaacttagaaagaactccctggctgtagctcctatgtaggtttaggttgagactctggattccacaatttttaaaggttaccatctgaggtttctgatcatagtctacttttgaagcagctgctgctgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaatttattaatacttttaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgtatttatgagctcattttcaaaatagtaagtttgtcatctttaaaatgaacatgacttgcctccttgatttctgaaatgaattaattgaagattgctatagtaatctttatttcatctttctagagttgttgacaattttattatacaacagttaccattagagaaggagggaagggctttgggtgtgtatttataggtactaagggatttactaaatatagtagattagcactgtcacacttgttcaagtagtttcaaacatagaaaattaagtatcaggtatgtggagcaatgtagtttttttttttcttcagtttaaaaaatttttaattgtggtagaagcaatgtattcttaaggtgaaaaacctacctcggttacatgtggtttgtgttttttggattaatctggattttataattagaaataaaaatgtaagattttgaatccaaaaaaaaaaaaaaaaaaaaaaaaaaaaaaaaaaaaaaaaaaaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgaaaaaaaaaaa

SEQ ID NO: 355767 - DNA, 4648 bp, Homo sapiens
ttttcattgtgtgggaataatgattaacttctacagttacaaataagttgctactataaccatatgtccttggggaatgttaatttttttaagctcaatagaaaatattcttggcatttttcttgctgaatactagggattttaataaaatgtttatatttccacagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagaggacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaatattgaaaaattgaatcactttaactcctgaaaaacatacaattgtaatttcaatgtaaaatttcttatgtaggtactacctttttttatcgttccaaggtttgctagtgaacacaggatattttaaaagttttttattcttcgggcctggaaagtgtacaaagtcagtgtaggagaaaaaaatccatatttttatattagcatgcacactaaaaaccaaaatattattcatacttaaaacattcatacaaaacaatatgtaagcagaaatagtactaaaatactttgcctaatttctaagttgaagaataacactgggacacagttttttcatatgagagaatattccgctatttcaaatttaagggattttcttcctaacattgaaattttaaaaacagagttacttctaaataattatacagattttttcttctattaaatattattatttagaattgtttttgtattacatattcatgttaagaaccccgtcttcccttaaaatacattaaaattatgacatttttgctttgtgattgaatttcaaatagcagtatggtatccttttatctagttaatatatgaaagtggcttgaatatagtcaaatccattttaggtactctactgactttttccttcacttgccaagcccttttattgttcactgttagaaaaatagagaaggtgagacagctgggggaaaatgtggagtaaatgataatcaaatgttgaattctaaaagtctctacatttacctaggttggctttctcccccagttcagaagtttccagcttggccaatcatcagaatcacttgaggaacttagaaagaactccctggctgtagctcctatgtaggtttaggttgagactctggattccacaatttttaaaggttaccatctgaggtttctgatcatagtctacttttgaagcagctgctgctgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaatttattaatacttttaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgtatttatgagctcattttcaaaatagtaagtttgtcatctttaaaatgaacatgacttgcctccttgatttctgaaatgaattaattgaagattgctatagtaatctttatttcatctttctagagttgttgacaattttattatacaacagttaccattagagaaggagggaagggctttgggtgtgtatttataggtactaagggatttactaaatatagtagattagcactgtcacacttgttcaagtagtttcaaacatagaaaattaagtatcaggtatgtggagcaatgtagtttttttttttcttcagtttaaaaaatttttaattgtggtagaagcaatgtattcttaaggtgaaaaacctacctcggttacatgtggtttgtgttttttggattaatctggattttataattagaaataaaaatgtaagattttgaatccaaaaaaaaaaaaaaaaaaaaaaaaaaaaaaaaaaaaaaaaaaaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgaaaaaaaaaaa

SEQ ID NO: 355768 - DNA, 4386 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggtaagtgtcccacttattaaataattatttttttctttcttgttttaggtaaacaatggtaggttttttgtttttattttgttattatggatgacagttttaattagtttaaatatttattgagttaatgtattttgcagcaacttctttatagaattctatcggggtttctctaggtacgaaatgaccttgttaaataaaatttaatttaccacataattcttttaatgaatttaaaaaaactgtcttgccttgattctgaaatgtactatacacattttgatagtgaatttgatatttttgaaatgccgtttatctcttatggcctgtacctaaaacgttttaatcataaatacatttattttaattctttataaacctaaaatactttcgttcttgaaataaagtttctaaatctggaacatcaaattttcaaattctttttaaagttaatttaataattttttaaaattttgagtttaaatatttaacttaagtaggctattttaaacaaaaaaaagattacaagaaaatccttatgccacttgatgtctttctgcaagtttttattgattgtaatacattcacttgtatttctcttcacttattgttgctcaaaggtctaggagtagtcataggaataactgtacaagtttagcctcatcagttgaaaatgtataaatgatccaaaagttaaaggaaaagtgcccaaagattgtttgtagtgtagctgagcagtagctagacttggtagggtttcgaccagagaagaaatgacatgctggtagctatgatcaaagagtaaatacttaggagctattgatataaaaacatttttcttccattctattttaaaataaccaatttgcccttttcaccaaaaaaaagagaaatggttaaaaaaaaagaatataaaaatagtgttataatgtctgtcatttgctagttgtaccttgcaatagctaccattttattatgctttctgcaagttttaaaaattagtgttctgagtcatgttttcaaaatggacataataattgctaaaatattgttttaataaatttaatattattatatcctgttagaatatttaactgttactgaattttatctccaggataggcagaaataataaaatcagttctctgttatactaacggttgagatgaaaggcatggataacaaactg

SEQ ID NO: 355769 - DNA, 2828 bp, Homo sapiens
cagctggtactccgtctcatttttgggaatgcaagagagagtgatgggcagaaaatctcacggactccaaataaagatcacagtgactccttagccctagctgcagttgctgtgcaggtatgtggtccctctttatcagataactgaatcttttttaagataacctgaaaagtccaatttttctgtgaagtcttgatttttgaatactggaactaattttaagactttatatgggacaaacacacttgcataacgaacagtctctgctttgcaaccatgaaggattttttaaatgtatcctttatagctcatatgctacattaagctgttttaatattgcaaagtaatcaatgagaaattttaaagtaataggagagcagaaaagtaatttgttcttttaccctaatttttatagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaaatgttaccagacctaaaagcagacaaccagaggctaaaggatgaaaatggggccttgatcagagttataagcaaactttccaaataaaaaaaaaaaagcagcaagtaatggaattgcacatattagtaacccagtggaccataattggcagtcactggaagtctgggaagaatccttggagactgtcattttcggatatcctgccaaatgccctcttatctagaatttttgtttcattttgtttaattttctggggtgtttttgttgttgttggtttgttttttgtttttttttttaatcaagaccattgtttcatgttaatgcagctgctgagaagatttttttttaatgactgagaaaacttgtttacagctccagcatataaggaaagtgttcaaggccagatatgcctcagatatttaaccagtaagccttagttgtacataaatacttttgtgtcaacaaaaactttcagctctcacagaagacagttactcaacattttttgatgtgccacagtttcgagtttttcgatatttaaattttttggcttttcatctaagtttgggtttgtattttttccttctaaactcttcatgtggcagagtcttctatgttttcacagctttttcattacagaaaagaacacttgctcttctgtgattattgtcatgtattaggctaatgctgtgttgtctcccacctggaactgaattgcttggtggaacatatgctttcactgtttgtgcaatatgcatttatttcttatatgaatgctttaaagtcatttgaggttagatcttttaattcctattttctgcttcattggtcactttttttttattgtagtataagatgttagattctgtaatcttcacattcattttagcaggtactgagtgatgctgtatatacaaataagtgtattgttttgatttttagaccaccacatggcatgcttgactatttcttatttcaaatgtctgctaatgcagagtaggctactccatgatagtgttaaaaaacaaaatttgctaacaatgtgatataaagactttaaaagttacacattatgtggagccctatctttacaaaagtttcctactgtaaagtgcttttattttcagttttcacttgatagtactcaaccataattaaagttgcataagataattgctttacatttcacatacctatatttatctgagtgctgtctaaaactgttgtgctagccaaagtaatgctatgaaatcatttgcagaattaacccgtgagttaatgttaaatgcactgttattgccatgtgaagaggcatcgactttgataccaccatcatgttcagaccattttatacatttcagtggccttttttttttttaaggaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgaaaaaaaaaaa

SEQ ID NO: 355770 - DNA, 3000 bp, Homo sapiens
ggtgcttttccatcccttaaagccaagcttatatatcaggatttcatcagctttgagctggtcagatagtacaggaagtggaaaaaatgaaaggcctgagctcaccagcagaagaaagctgtacagctagaatttcttataagtgaaagtggatgtgaaccaattgtggagcatggatgattggaaaagaaacctagagtgtgagccaagaccaagatagctgtgggagaagataaaaaggccagtttactggtctggctgcatggatacagagtcattcaacctgctgatgaatatatttcaatcaaggtcctggaatctgaccattctgattagccactcctgatggtgtaggaaaggaaagaatttgagcttcagaaggaaagctacagtttttttttgtttttcttccacatactcactcaccctcacgcccagctaaactatgaaagttcctggggaaaagtgatagagaacataaaatgagagctctggttaccattctatttctaaacattcattgcactctttattattttaatacaaatcctgttttctctttgctttactcacgaacctgtgttttactccacttgaatattgtgatttaatacctattaaaagagaattactgtggtcacccctgaacttttttgcacttatctcttttataatttcttactttgttgcagagacaagaaagatttgctgatagatcactgttggaaatggaaaaaagggaacgaagagctctagaaagaagaatatctgaaatggaagaagagctcaaaatgttaccagacctaaaagcagacaaccagaggctaaaggatgaaaatggggccttgatcagagttataagcaaactttccaaataaaaaaaaaaaagcagcaagtaatggaattgcacatattagtaacccagtggaccataattggcagtcactggaagtctgggaagaatccttggagactgtcattttcggatatcctgccaaatgccctcttatctagaatttttgtttcattttgtttaattttctggggtgtttttgttgttgttggtttgttttttgtttttttttttaatcaagaccattgtttcatgttaatgcagctgctgagaagatttttttttaatgactgagaaaacttgtttacagctccagcatataaggaaagtgttcaaggccagatatgcctcagatatttaaccagtaagccttagttgtacataaatacttttgtgtcaacaaaaactttcagctctcacagaagacagttactcaacattttttgatgtgccacagtttcgagtttttcgatatttaaattttttggcttttcatctaagtttgggtttgtattttttccttctaaactcttcatgtggcagagtcttctatgttttcacagctttttcattacagaaaagaacacttgctcttctgtgattattgtcatgtattaggctaatgctgtgttgtctcccacctggaactgaattgcttggtggaacatatgctttcactgtttgtgcaatatgcatttatttcttatatgaatgctttaaagtcatttgaggttagatcttttaattcctattttctgcttcattggtcactttttttttattgtagtataagatgttagattctgtaatcttcacattcattttagcaggtactgagtgatgctgtatatacaaataagtgtattgttttgatttttagaccaccacatggcatgcttgactatttcttatttcaaatgtctgctaatgcagagtaggctactccatgatagtgttaaaaaacaaaatttgctaacaatgtgatataaagactttaaaagttacacattatgtggagccctatctttacaaaagtttcctactgtaaagtgcttttattttcagttttcacttgatagtactcaaccataattaaagttgcataagataattgctttacatttcacatacctatatttatctgagtgctgtctaaaactgttgtgctagccaaagtaatgctatgaaatcatttgcagaattaacccgtgagttaatgttaaatgcactgttattgccatgtgaagaggcatcgactttgataccaccatcatgttcagaccattttatacatttcagtggccttttttttttttaaggaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgaaaaaaaaaaa

SEQ ID NO: 355771 - DNA, 3290 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccaccattttcatcctttagcctctggttgtctgcttttaggtctggtaacattttgagctcttcttccatttcagatattcttctttctagagctcttcgttccgcccagaagatactgactcttgccggtcagtcgacgcggccggc

SEQ ID NO: 355772 - DNA, 2838 bp, Homo sapiens
ttgagacagagttttgctctagttgcccaggctggagtgcaatggcgcaatctcagctcactgcaatctccacctcccaggttcaagcagttctcctgcctcagcctcctgagtagctaggattacaggcatgcgccaccacgcccggctaattttgtatttttaatagagatggggtttctccatgttggtcaggctggtctcaaactcctgaactctggattccacaatttttaaaggttaccatctgaggtttctgatcatagtctacttttgaagcagctgctgctgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaatttattaatacttttaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgtatttatgagctcattttcaaaatagtaagtttgtcatctttaaaatgaacatgacttgcctccttgatttctgaaatgaattaattgaagattgctatagtaatctttatttcatctttctagagttgttgacaattttattatacaacagttaccattagagaaggagggaagggctttgggtgtgtatttataggtactaagggatttactaaatatagtagattagcactgtcacacttgttcaagtagtttcaaacatagaaaattaagtatcaggtatgtggagcaatgtagtttttttttttcttcagtttaaaaaatttttaattgtggtagaagcaatgtattcttaaggtgaaaaacctacctcggttacatgtggtttgtgttttttggattaatctggattttataattagaaataaaaatgtaagattttgaatccaaaaaaaaaaaaaaaaaaaaaaaaaaaaaaaaaaaaaaaaaaaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgaaaaaaaaaaa

SEQ ID NO: 355773 - DNA, 2634 bp, Homo sapiens
ttttggggaaaaaatttttccccaaaaaaaaaaaaaggggttttccccataaaaaaactctttttttgaaaagcaagcttgtgcttgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaatttattaatacttttaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgtatttatgagctcattttcaaaatagtaagtttgtcatctttaaaatgaacatgacttgcctccttgatttctgaaatgaattaattgaagattgctatagtaatctttatttcatctttctagagttgttgacaattttattatacaacagttaccattagagaaggagggaagggctttgggtgtgtatttataggtactaagggatttactaaatatagtagattagcactgtcacacttgttcaagtagtttcaaacatagaaaattaagtatcaggtatgtggagcaatgtagtttttttttttcttcagtttaaaaaatttttaattgtggtagaagcaatgtattcttaaggtgaaaaacctacctcggttacatgtggtttgtgttttttggattaatctggattttataattagaaataaaaatgtaagattttgaatccaaaaaaaaaaaaaaaaaaaaaaaaaaaaaaaaaaaaaaaaaaaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgaaaaaaaaaaa

SEQ ID NO: 355774 - DNA, 955 bp, Homo sapiens
gaccagatacagaatgcacagtatttgctgcagaacagtgttcctgtaatggtaatgatccgatcttcggatcccttctaaaggctcatcaattttgatcctcgagttttttttttttttttttaaggaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgaaaaaaaaaaa

SEQ ID NO: 355775 - DNA, 857 bp, Homo sapiens
aggcagatctgccctgtagagccttgcggttccactgctggcctccggattcccgggagcccccagcccgacaggacaaccttccttccccgcttcctcctttccagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggtaaaataaaaagcaacctaaatggaaaaatgttttagaaagaatgtgatacttttccagcaaaaatatttgttgacattgaagggcaatcataatttcatgaaaaaaatgaattcagcttgcaaaacaatagtacagtatgtttctgttttctaaaatattctccactctatcttttaagtatttttaaagttaaaagaaatgttagaagcagcaggatcaggcataaaattatgtggaagt

SEQ ID NO: 355776 - DNA, 456 bp, Homo sapiens
cataaaagcaaaagtctttggtttaggtgctgacaggaacctcttttaagagcctatcctaacaaaaacaggcttgtcttggctgctggaatgtggtgtgcttgtgagtcataaaatcaagtgatttagtaaatttcaatggaaaatttggagagaataaacctttcattccagcatttatgaaactaattagctttacaaatccaggtgtggtttttttccttcttcctgatacatgttttagatactagaaatatatataactgacaaagcttgatcatgtgttttgtggtgaaaatataacatttattaagaataatgttttatcttttaatattgaaggtaaaacttgatcttcaatttttctctttatagatgttaccagacctaaaagcagacaaccagaggctaaaggatgaaaatggggccttgatcagagttataagcaaactttcc

SEQ ID NO: 355777 - DNA, 296 bp, Homo sapiens
attactttatcttcttgattagtattcctaagtgtcctcccaaaggtttttactagtttcagcttatactaatatttactagtgtaccgctttcttaatcctattttaaaattatgtaccagaatctgaagggtgttcttttaacagagattcttcaagtttgcgaacaagtagttcatatacaaggagaaaatgggaagatgatcttaaaaaaaatagctcagttaatgaaggatcaacgtatcataaaaggtaataatactattcttaagcggtttttatgtattcatttataa

SEQ ID NO: 355778 - DNA, 463 bp, Homo sapiens
cctgcaataaatcagttttacatacaaagtgattcatcagttttcgattttacattgaaaaattatgggcttttctgtgaaaatttcacttacaagtcatattaacaagaattaatcagtgtcacaccaaaccataagacttagagtcattaggaattaattaaaactgcattattatggcaatgactcaagatcctctttttctgagttttttctgagaattactttgtatttgccatagttaattcattgagggggaaggatgtaaattctgaaaagaaattaattgaaaattgtagttaaattgcatgatagatagcttttgatcatgatcatttatttctagattttaatgattgtctaattcactgtaatttctttagacttttaatacaggcaggctatgatgttaatattaaagactatgatggctggacacctcttcatgctgcagctcattggg

SEQ ID NO: 355779 - DNA, 735 bp, Homo sapiens
aacatgaatgaaccttgaaaacatgtagagtgaaagaagccagtcacaaagaaccatatattctatgattccatttataggaaatgcctagcataggtagacctatagagacagaaagtagattagtggttgccttgggctggatgcagacagtgactactaaagggtatgttcctacttcttagggtgataaaaatatttgaaattgattattttgatagttgtacaactctgaatatccataaaaccattgaattgtacactttaaatgagtgatttgtatggtatatgaattatatctcaataaagctgttaccaaaaaaataaggggagatattctcagcttctgtctcacataaatttcacatacattgccttagagttgtatgtttttacagtagttattgtatcataaccactgtaaaaaatgttatccaacgtctttatataaaattatacagaattactgaaggcattttatgatttattgacttttgaccatcaccatccccccttgtttcctacgtagggccaaacagcctttgatgtagcagatgaagacattttaggatatttagaagagttgcaaaagaaacaaaatctggtatgtttgatgactaataattgcctatattacttaccttaataattttgaatttgagacaattacaaaagtattcttgtgatgttttgtactttttggttttaagttatccttaagtttcactaaatgat

SEQ ID NO: 355780 - DNA, 403 bp, Homo sapiens
ctgggattacaggcgtgagccactgcgcctggcctgatagttttttaaaatttaaataatgtatatactgccctttattgctgctttatataggaactttcctcattggttatgcatttagttttatttcaatgataatatcttttgcttaactatttttcctttggttttacaggtttttgattggtcaaggagcacatgtaggggctgtcaacagtgaaggagatacacctttagatattgcggaggaggaggcaatggaagagctacttcaaaatgaagttaatcggcaaggtaaaataaaaagcaacctaaatggaaaaatgttttagaaagaatgtgatacttttccagcaaaaatatttgttgacattgaagggcaatcataatttcatgaaaaaaa

SEQ ID NO: 355781 - DNA, 1364 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaagaaagaaaaagaacgaaggaggaggagaggaaggagaaggaagaagaaaaagaaggagaaggaagaaggagaagaat

SEQ ID NO: 355782 - DNA, 5342 bp, Homo sapiens
aggcagatctgccctgtagagccttgcggttccactgctggcctccggattcccgggagcccccagcccgacaggacaaccttccttccccgcttcctcctttccagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaaatgttaccagacctaaaagcagacaaccagaggctaaaggatgaaaatggggccttgatcagagttataagcaaactttccaaataaaaaaaaaaaagcagcaagtaatggaattgcacatattagtaacccagtggaccataattggcagtcactggaagtctgggaagaatccttggagactgtcattttcggatatcctgccaaatgccctcttatctagaatttttgtttcattttgtttaattttctggggtgtttttgttgttgttggtttgttttttgtttttttttttaatcaagaccattgtttcatgttaatgcagctgctgagaagatttttttttaatgactgagaaaacttgtttacagctccagcatataaggaaagtgttcaaggccagatatgcctcagatatttaaccagtaagccttagttgtacataaatacttttgtgtcaacaaaaactttcagctctcacagaagacagttactcaacattttttgatgtgccacagtttcgagtttttcgatatttaaattttttggcttttcatctaagtttgggtttgtattttttccttctaaactcttcatgtggcagagtcttctatgttttcacagctttttcattacagaaaagaacacttgctcttctgtgattattgtcatgtattaggctaatgctgtgttgtctcccacctggaactgaattgcttggtggaacatatgctttcactgtttgtgcaatatgcatttatttcttatatgaatgctttaaagtcatttgaggttagatcttttaattcctattttctgcttcattggtcactttttttttattgtagtataagatgttagattctgtaatcttcacattcattttagcaggtactgagtgatgctgtatatacaaataagtgtattgttttgatttttagaccaccacatggcatgcttgactatttcttatttcaaatgtctgctaatgcagagtaggctactccatgatagtgttaaaaaacaaaatttgctaacaatgtgatataaagactttaaaagttacacattatgtggagccctatctttacaaaagtttcctactgtaaagtgcttttattttcagttttcacttgatagtactcaaccataattaaagttgcataagataattgctttacatttcacatacctatatttatctgagtgctgtctaaaactgttgtgctagccaaagtaatgctatgaaatcatttgcagaattaacccgtgagttaatgttaaatgcactgttattgccatgtgaagaggcatcgactttgataccaccatcatgttcagaccattttatacatttcagtggccttttttttttttaaggaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgaaaaaaaaaaa

SEQ ID NO: 355783 - DNA, 5950 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcaaaaaaaaaaaaaaaaaaaaaaaaaaaaaaaaaaaaaaaaaaaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgaaaaaaaaaaa

SEQ ID NO: 355784 - DNA, 5489 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggtgaccggcaagagtcagtatcttctgggcgggaacgaagagctctagaaagaagaatatctgaaatggaagaagagctcaaaatgttaccagacctaaaagcagacaaccagaggctaaaggatgaaaatggggccttgatcagagttataagcaaactttccaaataaaaaaaaaaaagcagcaagtaatggaattgcacatattagtaacccagtggaccataattggcagtcactggaagtctgggaagaatccttggagactgtcattttcggatatcctgccaaatgccctcttatctagaatttttgtttcattttgtttaattttctggggtgtttttgttgttgttggtttgttttttgtttttttttttaatcaagaccattgtttcatgttaatgcagctgctgagaagatttttttttaatgactgagaaaacttgtttacagctccagcatataaggaaagtgttcaaggccagatatgcctcagatatttaaccagtaagccttagttgtacataaatacttttgtgtcaacaaaaactttcagctctcacagaagacagttactcaacattttttgatgtgccacagtttcgagtttttcgatatttaaattttttggcttttcatctaagtttgggtttgtattttttccttctaaactcttcatgtggcagagtcttctatgttttcacagctttttcattacagaaaagaacacttgctcttctgtgattattgtcatgtattaggctaatgctgtgttgtctcccacctggaactgaattgcttggtggaacatatgctttcactgtttgtgcaatatgcatttatttcttatatgaatgctttaaagtcatttgaggttagatcttttaattcctattttctgcttcattggtcactttttttttattgtagtataagatgttagattctgtaatcttcacattcattttagcaggtactgagtgatgctgtatatacaaataagtgtattgttttgatttttagaccaccacatggcatgcttgactatttcttatttcaaatgtctgctaatgcagagtaggctactccatgatagtgttaaaaaacaaaatttgctaacaatgtgatataaagactttaaaagttacacattatgtggagccctatctttacaaaagtttcctactgtaaagtgcttttattttcagttttcacttgatagtactcaaccataattaaagttgcataagataattgctttacatttcacatacctatatttatctgagtgctgtctaaaactgttgtgctagccaaagtaatgctatgaaatcatttgcagaattaacccgtgagttaatgttaaatgcactgttattgccatgtgaagaggcatcgactttgataccaccatcatgttcagaccattttatacatttcagtggccttttttttttttaaggaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgaaaaaaaaaaa

SEQ ID NO: 355785 - DNA, 7349 bp, Homo sapiens
aggcagatctgccctgtagagccttgcggttccactgctggcctccggattcccgggagcccccagcccgacaggacaaccttccttccccgcttcctcctttccagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtcagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaatattgaaaaattgaatcactttaactcctgaaaaacatacaattgtaatttcaatgtaaaatttcttatgtaggtactacctttttttatcgttccaaggtttgctagtgaacacaggatattttaaaagttttttattcttcgggcctggaaagtgtacaaagtcagtgtaggagaaaaaaatccatatttttatattagcatgcacactaaaaaccaaaatattattcatacttaaaacattcatacaaaacaatatgtaagcagaaatagtactaaaatactttgcctaatttctaagttgaagaataacactgggacacagttttttcatatgagagaatattccgctatttcaaatttaagggattttcttcctaacattgaaattttaaaaacagagttacttctaaataattatacagattttttcttctattaaatattattatttagaattgtttttgtattacatattcatgttaagaaccccgtcttcccttaaaatacattaaaattatgacatttttgctttgtgattgaatttcaaatagcagtatggtatccttttatctagttaatatatgaaagtggcttgaatatagtcaaatccattttaggtactctactgactttttccttcacttgccaagcccttttattgttcactgttagaaaaatagagaaggtgagacagctgggggaaaatgtggagtaaatgataatcaaatgttgaattctaaaagtctctacatttacctaggttggctttctcccccagttcagaagtttccagcttggccaatcatcagaatcacttgaggaacttagaaagaactccctggctgtagctcctatgtaggtttaggttgagactctggattccacaatttttaaaggttaccatctgaggtttctgatcatagtctacttttgaagcagctgctgctgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaatttattaatacttttaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgtatttatgagctcattttcaaaatagtaagtttgtcatctttaaaatgaacatgacttgcctccttgatttctgaaatgaattaattgaagattgctatagtaatctttatttcatctttctagagttgttgacaattttattatacaacagttaccattagagaaggagggaagggctttgggtgtgtatttataggtactaagggatttactaaatatagtagattagcactgtcacacttgttcaagtagtttcaaacatagaaaattaagtatcaggtatgtggagcaatgtagtttttttttttcttcagtttaaaaaatttttaattgtggtagaagcaatgtattcttaaggtgaaaaacctacctcggttacatgtggtttgtgttttttggattaatctggattttataattagaaataaaaatgtaagattttgaatccaaaaaaaaaaaaaaaaaaaaaaaaaaaaaaaaaaaaaaaaaaaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgaaaaaaaaaaa

SEQ ID NO: 355786 - DNA, 6463 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaatattgaaaaattgaatcactttaactcctgaaaaacatacaattgtaatttcaatgtaaaatttcttatgtaggtactacctttttttatcgttccaaggtttgctagtgaacacaggatattttaaaagttttttattcttcgggcctggaaagtgtacaaagtcagtgtaggagaaaaaaatccatatttttatattagcatgcacactaaaaaccaaaatattattcatacttaaaacattcatacaaaacaatatgtaagcagaaatagtactaaaatactttgcctaatttctaagttgaagaataacactgggacacagttttttcatatgagagaatattccgctatttcaaatttaagggattttcttcctaacattgaaattttaaaaacagagttacttctaaataattatacagattttttcttctattaaatattattatttagaattgtttttgtattacatattcatgttaagaaccccgtcttcccttaaaatacattaaaattatgacatttttgctttgtgattgaatttcaaatagcagtatggtatccttttatctagttaatatatgaaagtggcttgaatatagtcaaatccattttaggtactctactgactttttccttcacttgccaagcccttttattgttcactgttagaaaaatagagaaggtgagacagctgggggaaaatgtggagtaaatgataatcaaatgttgaattctaaaagtctctacatttacctaggttggctttctcccccagttcagaagtttccagcttgtaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgta

SEQ ID NO: 355787 - DNA, 5262 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagaggacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttg

SEQ ID NO: 355788 - DNA, 4393 bp, Homo sapiens
  misc_feature (4358)..(4358): n is a, c, g, or t
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggggttcccccttaaggnaaatttttttttttttttaaaaaaccccccaaaag

SEQ ID NO: 355789 - DNA, 4862 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagttaaaaatatgaagattaaggggaaattgaagacaaggctttggaaaagctacattcctcaacttgatttttaaaagtagctgatgatccaaataaaagaatttgtcattttcaatcttttcctcattgttcatctgacagcggtcttattttgggaaatatcttggcagatgttaaacttcactttttttctggctgcatgtgctaaaattatttttcaagtactttttttttttttaaacaagggtaatgtttactgggggaagtaagtagagtgtatcttgtgagatcctaagaaacatcttttgttaatacccctgctttgagtaagagaacatagtgctgagaatgtagatgacttcccactacaatggagtctaatactctggaatgtttttcgtttgggtgttggcaactcctaaatttaatcttccctgaaaacaaacaaaccaagggtacctttttttttgtctgtagagtttgaacctttttattgaatagggaattgaggactgctttcttttagtggtaactatgtctctgtccgtttcaagctgcaggacccaacaaaacagtaatgcttcactacagtatctaattaacagacatacttcttgagcgcctcctcctcatattttcttatttttcaaaacaacttatgtatttcagattattttaatagtggtaaaatatatgatgcaaaactttaaagctgagccattttcatgtgtttatattgttgcttttt

SEQ ID NO: 355790 - DNA, 4491 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacggttcagggcgattttaattggacagagattatcctttatagagcgaggagctgttacaaggagtgggagtgttggaggggtaagagcatggggccgtgaagactctaaggggtggagccagtatgtagagttgggttgggagtctgatatatcggtcttcggtattgtgcttttctatagaggtgatacctcaggctgtgttatctcaggtagcgtatatgtatttctgg

SEQ ID NO: 355791 - DNA, 3402 bp, Homo sapiens
tgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccaccagagctctccagtacaggatacaacagagacaagaaagatttgctgatagatcactgttgggaatgccaaaagggaacgaagaggtctagaaagagaattttgaatggggaagaggtcaaatggttcagactaaaagagagaaccgagggtaaggtggaaaaggggctggacaaggttaagcaattcaattaaaaaaaaagggggggaaaaaccaggggccgttggtcaatttggaaaaggccaaggggaaaaaag

SEQ ID NO: 355792 - DNA, 304 bp, Homo sapiens
caacacagtttctctgatgtcggcctcggctgtgcttcttctttgggggtgaagagagtggggaggcagtctccacccctgggaggcagaagccaggcatagcgcgctggctaggactccagtagtgtgagtgtgtgagcaacagtaccccattccagtcgtttcctgctgtgactaagtcagcaacagtctgaactccactgaattaaaccactggcatttgggggctgtttattatagcagtgcaaagagttcctttatcctccccaaggatggaaaaatacaatttattttgcttaccata

SEQ ID NO: 355793 - DNA, 5055 bp, Homo sapiens
gggagtctggattataatcgcgacctaagatactggtcaaacatgccttatttcgagatcgatagggtctcaccatgttgcccaggctggtcttgaactcctggactcatcctaaagtgctggcctctcattccctgtctgtgcacacctcacggcaagggccagcctgtttcctcccggtcacctccaaatcttgctgcttttaattcaactcagaggtatgcacttgaggtaggagggcaggggaagtggggatggcaggacatggatggcccttgaggcattggctctgggtgtcatgggctgtgagagtcaagaagggcagtggcctgcctgacttgggttcgaaagggtcactctggccactgcggtgagaactgaaactagccaggccaattctccattgttcctgctcttccaggtaggagaatattagattaggtctggagtcagaaggtagcaggggctgggggttgcagggggatgttgagaagaagtggtcctttggtcagggtgggaagccaacaggatttcctggtgcattggaggtgaaagggaagaggcgctggtggttgtgctttgggcctgagcagccagaagccgttgccatcacctatgacaagggagacagcgcctggggcagagcccagtatggggtgcattcagggtagatcaggaggtatgagtgggcagtgggcgagccaggctgggggttgtgggggaggcctgggttgcaggtttaagcgtgggacccacgtcagattggtggtgggtcatgcatgctggggtggctctcaggtcctccctgctggcttcccactcccaggggctttctcctcccagattccttagctgggtgaggggcaggacagagccctttcctagggaagcccggcaccccctgctgtccagggaaggggagtccttctagcccctgacagcttctctgcccctcccctggcctccccaggcctagccagggttgagttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggtgaggggtccaggagggcagggaggggctcgggaactggccatccatctgattcttgcctctgtgcccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcatagcgcgctggctaggactccagtaccgtgaagggaggcagtgagagcagacatctgtgcctcattcctgatctcaaggggaaagcaagaacaagacctgtgaagggaaggagggtggatcggcctgactggccctgggaagcacagaggagcctactgggaccagggaagagactgacaagagaagggaggcctgtccctgcctgcttctgtctcaagaagattgttatcacttcctctggtgaaatcctgccttcctgtccccacggcccctcagctgatgccaccttactctggagaggatgggcagagcctcctatggagggagccctgtgggtcaccaaagctccagtgaccacccccgggcaaagacctgcagatcccctgttagagacgggcccaggactttgtgcggggtgcccactgttgctctgagccttcacttcctcagggaggcttcctcaggatctcgaacctgcggaaggaggaccagtctgtgtacttctgccaagtccagctggacatacagatcagggaggctgtcgtggcagtccatcaaggggacccacctcaccatcacccagggtgagtccagctgccctggcaccaaggaaccttcctggttcagccataggctcaggtgtgtggagggaatgacctgaggggctgtatgagggaacaacctcctggggctcccctatgcctgagttcctgcaactcagaagttgaggcccagagatccaggtagagggggctccagtcctgggactgccctgcaagtcatgtggcctgggacagggcttctccaagctctgtcccctcctgtgtagggcagggaggtcagaggggaccctgcagatccagtctcatgtctgggggtcaaggggtggcctcgagagggaccagtctctgtgtaggggaccgtcagccccctcaccccttgagcaagactgtggtccctgcaccaagggagcaggcctggggtgggaagaggccagctgggctgtggtggtgcctggggactgcatgggagcccctgccagggagggagagggacagaggacaagctgggggctctggtgcttgggctgggggctgagcgcctgtgacctccactggcttcctccttctcctctctgaggactgaatctggggtgcagcagagcacagactcaggcccgcctttcctctccctgaaagagcctgcgctggccttggacagagaaagggatgagaagtgaggctgagtgcggtggggtctgcagggatccaggtgggaggggcccagccagccaaggtgaggcccagcccctcagcaggaagatgggcactggggcccttgggcagggctgacttgacacttttgtgtgacttgagccactgtgcccagcctgaacaccctttcctggtaaaacactccacaaaccaggaagagaaggaatgtactgcaacaaaataaaggccagtcatgcaaggcccatggctgaaagtctttcagtcattttagatgaaagactgaaatctttgcctccaagatcaggaacaagagaaggatgcccgctctcactacttctattcaacacaggatttgaagtcaggccgggcacagtggctcacgcctgtaatcccagcacttttggaggctgaggcgggcagattacttgagcctatgagtgtgagaccaccctggccaacatggcaaaaccccatctctactaaaaaaaaaaaaaaaaaaggatttgaagtcctggccggagcaattaggcaagggataaaaaggcacctaaggcccttttgcaataagaagccagatggataaaggaagtgctggtcaccctggaggtgtactggtttggggaaggtccccggcccccacagccctctggggagcctcaccctggctctccccactcacctcagccccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccatacaccccttttctcctcgtccacattttccaatctgtatggtggctgtcttctatggcagaaggttttggggaataaatagcgtgaaatgctgctgacact

SEQ ID NO: 355794 - DNA, 4955 bp, Homo sapiens
gggagtctggattataatcgcgacctaagatactggtcaaacatgccttatttcgagatcgatagggtctcaccatgttgcccaggctggtcttgaactcctggactcatcctaaagtgctggcctctcattccctgtctgtgcacacctcacggcaagggccagcctgtttcctcccggtcacctccaaatcttgctgcttttaattcaactcagaggtatgcacttgaggtaggagggcaggggaagtggggatggcaggacatggatggcccttgaggcattggctctgggtgtcatgggctgtgagagtcaagaagggcagtggcctgcctgacttgggttcgaaagggtcactctggccactgcggtgagaactgaaactagccaggccaattctccattgttcctgctcttccaggtaggagaatattagattaggtctggagtcagaaggtagcaggggctgggggttgcagggggatgttgagaagaagtggtcctttggtcagggtgggaagccaacaggatttcctggtgcattggaggtgaaagggaagaggcgctggtggttgtgctttgggcctgagcagccagaagccgttgccatcacctatgacaagggagacagcgcctggggcagagcccagtatggggtgcattcagggtagatcaggaggtatgagtgggcagtgggcgagccaggctgggggttgtgggggaggcctgggttgcaggtttaagcgtgggacccacgtcagattggtggtgggtcatgcatgctggggtggctctcaggtcctccctgctggcttcccactcccaggggctttctcctcccagattccttagctgggtgaggggcaggacagagccctttcctagggaagcccggcaccccctgctgtccagggaaggggagtccttctagcccctgacagcttctctgcccctcccctggcctccccaggcctagccagggttgagttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggtgaggggtccaggagggcagggaggggctcgggaactggccatccatctgattcttgcctctgtgcccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcatagcgcgctggctaggactccagtaccgtgaagggaggcagtgagagcagacatctgtgcctcattcctgatctcaaggggaaagcaagaacaagacctgtgaagggaaggagggtggatcggcctgactggccctgggaagcacagaggagcctactgggaccagggaagagactgacaagagaagggaggcctgtccctgcctgcttctgtctcaagaagattgttatcacttcctctggtgaaatcctgccttcctgtccccacggcccctcagctgatgccaccttactctggagaggatgggcagagcctcctatggagggagccctgtgggtcaccaaagctccagtgaccacccccgggcaaagacctgcagatcccctgttagagacgggcccaggactttgtgcggggtgcccactgttgctctgagccttcacttcctcagggaggcttcctcaggatctcgaacctgcggaaggaggaccagtctgtgtacttctgccaagtccagctggacatacagatcagggaggctgtcgtggcagtccatcaaggggacccacctcaccatcacccagggtgagtccagctgccctggcaccaaggaaccttcctggttcagccataggctcaggtgtgtggagggaatgacctgaggggctgtatgagggaacaacctcctggggctcccctatgcctgagttcctgcaactcagaagttgaggcccagagatccaggtagagggggctccagtcctgggactgccctgcaagtcatgtggcctgggacagggcttctccaagctctgtcccctcctgtgtagggcagggaggtcagaggggaccctgcagatccagtctcatgtctgggggtcaaggggtggcctcgagagggaccagtctctgtgtaggggaccgtcagccccctcaccccttgagcaagactgtggtccctgcaccaagggagcaggcctggggtgggaagaggccagctgggctgtggtggtgcctggggactgcatgggagcccctgccagggagggagagggacagaggacaagctgggggctctggtgcttgggctgggggctgagcgcctgtgacctccactggcttcctccttctcctctctgaggactgaatctggggtgcagcagagcacagactcaggcccgcctttcctctccctgaaagagcctgcgctggccttggacagagaaagggatgagaagtgaggctgagtgcggtggggtctgcagggatccaggtgggaggggcccagccagccaaggtgaggcccagcccctcagcaggaagatgggcactggggcccttgggcagggctgacttgacacttttgtgtgacttgagccactgtgcccagcctgaacaccctttcctggtaaaacactccacaaaccaggaagagaaggaatgtactgcaacaaaataaaggccagtcatgcaaggcccatggctgaaagtctttcagtcattttagatgaaagactgaaatctttgcctccaagatcaggaacaagagaaggatgcccgctctcactacttctattcaacacaggatttgaagtcaggccgggcacagtggctcacgcctgtaatcccagcacttttggaggctgaggcgggcagattacttgagcctatgagtgtgagaccaccctggccaacatggcaaaaccccatctctactaaaaaaaaaaaaaaaaaaggatttgaagtcctggccggagcaattaggcaagggataaaaaggcacctaaggcccttttgcaataagaagccagatggataaaggaagtgctggtcaccctggaggtgtactggtttggggaaggtccccggcccccacagccctctggggagcctcaccctggctctccccactcacctcagccccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccata

SEQ ID NO: 355795 - DNA, 3055 bp, Homo sapiens
  misc_feature (33)..(33): n is a, c, g, or t
tgcagcggactcggcactgagagcacgagcatnggcacccagccaggcctcccaggctgctctccacgtcccttatgccactatcaacaccagctgctgcccagctactttggacacagctcacccccgacagggggccgtcctgtcgtttcctgctgtgactaagtcagcaacacagttcctctgacatgggccttggctgtgcttctttgggggtgaagagattggggaggaagtctccacccctgggaggcagaagccaggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagggaggctgtcgtggcagtccatcaaggggacccacctcaccatcacccagggtgagtccagctgccctggcaccaaggaaccttcctggttcagccataggctcaggtgtgtggagggaatgacctgaggggctgtatgagggaacaacctcctggggctcccctatgcctgagttcctgcaactcagaagttgaggcccagagatccaggtagagggggctccagtcctgggactgccctgcaagtcatgtggcctgggacagggcttctccaagctctgtcccctcctgtgtagggcagggaggtcagaggggaccctgcagatccagtctcatgtctgggggtcaaggggtggcctcgagagggaccagtctctgtgtaggggaccgtcagccccctcaccccttgagcaagactgtggtccctgcaccaagggagcaggcctggggtgggaagaggccagctgggctgtggtggtgcctggggactgcatgggagcccctgccagggagggagagggacagaggacaagctgggggctctggtgcttgggctgggggctgagcgcctgtgacctccactggcttcctccttctcctctctgaggactgaatctggggtgcagcagagcacagactcaggcccgcctttcctctccctgaaagagcctgcgctggccttggacagagaaagggatgagaagtgaggctgagtgcggtggggtctgcagggatccaggtgggaggggcccagccagccaaggtgaggcccagcccctcagcaggaagatgggcactggggcccttgggcagggctgacttgacacttttgtgtgacttgagccactgtgcccagcctgaacaccctttcctggtaaaacactccacaaaccaggaagagaaggaatgtactgcaacaaaataaaggccagtcatgcaaggcccatggctgaaagtctttcagtcattttagatgaaagactgaaatctttgcctccaagatcaggaacaagagaaggatgcccgctctcactacttctattcaacacaggatttgaagtcaggccgggcacagtggctcacgcctgtaatcccagcacttttggaggctgaggcgggcagattacttgagcctatgagtgtgagaccaccctggccaacatggcaaaaccccatctctactaaaaaaaaaaaaaaaaaaggatttgaagtcctggccggagcaattaggcaagggataaaaaggcacctaaggcccttttgcaataagaagccagatggataaaggaagtgctggtcaccctggaggtgtactggtttggggaaggtccccggcccccacagccctctggggagcctcaccctggctctccccactcacctcagccccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccatacaccccttttctcctcgtccacattttccaatctgtatggtggctgtcttctatggcagaaggttttggggaataaatagcgtgaaatgctgctgacact

SEQ ID NO: 355796 - DNA, 3409 bp, Homo sapiens
gggagtctggattataatcgcgacctaagatactggtcaaacatgccttatttcgagatcgatagggtctcaccatgttgcccaggctggtcttgaactcctggactcatcctaaagtgctggcctctcattccctgtctgtgcacacctcacggcaagggccagcctgtttcctcccggtcacctccaaatcttgctgcttttaattcaactcagaggtatgcacttgaggtaggagggcaggggaagtggggatggcaggacatggatggcccttgaggcattggctctgggtgtcatgggctgtgagagtcaagaagggcagtggcctgcctgacttgggttcgaaagggtcactctggccactgcggtgagaactgaaactagccaggccaattctccattgttcctgctcttccaggtaggagaatattagattaggtctggagtcagaaggtagcaggggctgggggttgcagggggatgttgagaagaagtggtcctttggtcagggtgggaagccaacaggatttcctggtgcattggaggtgaaagggaagaggcgctggtggttgtgctttgggcctgagcagccagaagccgttgccatcacctatgacaagggagacagcgcctggggcagagcccagtatggggtgcattcagggtagatcaggaggtatgagtgggcagtgggcgagccaggctgggggttgtgggggaggcctgggttgcaggtttaagcgtgggacccacgtcagattggtggtgggtcatgcatgctggggtggctctcaggtcctccctgctggcttcccactcccaggggctttctcctcccagattccttagctgggtgaggggcaggacagagccctttcctagggaagcccggcaccccctgctgtccagggaaggggagtccttctagcccctgacagcttctctgcccctcccctggcctccccaggcctagccagggttgagttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggtgaggggtccaggagggcagggaggggctcgggaactggccatccatctgattcttgcctctgtgcccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcatagcgcgctggctaggactccagtaccgtgaagggaggcagtgagagcagacatctgtgcctcattcctgatctcaaggggaaagcaagaacaagacctgtgaagggaaggagggtggatcggcctgactggccctgggaagcacagaggagcctactgggaccagggaagagactgacaagagaagggaggcctgtccctgcctgcttctgtctcaagaagattgttatcacttcctctggtgaaatcctgccttcctgtccccacggcccctcagctgatgccaccttactctggagaggatgggcagagcctcctatggagggagccctgtgggtcaccaaagctccagtgaccacccccgggcaaagacctgcagatcccctgttagagacgggcccaggactttgtgcggggtgcccactgttgctctgagccttcacttcctcagggaggcttcctcaggatctcgaacctgcggaaggaggaccagtctgtgtacttctgccaagtccagctggacatacagatcagggaggctgtcgtggcagtccatcaaggggacccacctcaccatcacccaggccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccata

SEQ ID NO: 355797 - DNA, 5212 bp, Homo sapiens
gggagtctggattataatcgcgacctaagatactggtcaaacatgccttatttcgagatcgatagggtctcaccatgttgcccaggctggtcttgaactcctggactcatcctaaagtgctggcctctcattccctgtctgtgcacacctcacggcaagggccagcctgtttcctcccggtcacctccaaatcttgctgcttttaattcaactcagaggtatgcacttgaggtaggagggcaggggaagtggggatggcaggacatggatggcccttgaggcattggctctgggtgtcatgggctgtgagagtcaagaagggcagtggcctgcctgacttgggttcgaaagggtcactctggccactgcggtgagaactgaaactagccaggccaattctccattgttcctgctcttccaggtaggagaatattagattaggtctggagtcagaaggtagcaggggctgggggttgcagggggatgttgagaagaagtggtcctttggtcagggtgggaagccaacaggatttcctggtgcattggaggtgaaagggaagaggcgctggtggttgtgctttgggcctgagcagccagaagccgttgccatcacctatgacaagggagacagcgcctggggcagagcccagtatggggtgcattcagggtagatcaggaggtatgagtgggcagtgggcgagccaggctgggggttgtgggggaggcctgggttgcaggtttaagcgtgggacccacgtcagattggtggtgggtcatgcatgctggggtggctctcaggtcctccctgctggcttcccactcccaggggctttctcctcccagattccttagctgggtgaggggcaggacagagccctttcctagggaagcccggcaccccctgctgtccagggaaggggagtccttctagcccctgacagcttctctgcccctcccctggcctccccaggcctagccagggttgagttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggtgaggggtccaggagggcagggaggggctcgggaactggccatccatctgattcttgcctctgtgcccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcatagcgcgctggctaggactccagtaccgtgaagggaggcagtgagagcagacatctgtgcctcattcctgatctcaaggggaaagcaagaacaagacctgtgaagggaaggagggtggatcggcctgactggccctgggaagcacagaggagcctactgggaccagggaagagactgacaagagaagggaggcctgtccctgcctgcttctgtctcaagaagattgttatcacttcctctggtgaaatcctgccttcctgtccccacggcccctcagctgatgccaccttactctggagaggatgggcagagcctcctatggagggagccctgtgggtcaccaaagctccagtgaccacccccgggcaaagacctgcagatcccctgttagagacgggcccaggactttgtgcggggtgcccactgttgctctgagccttcacttcctcagggaggcttcctcaggatctcgaacctgcggaaggaggaccagtctgtgtacttctgccaagtccagctggacatacagatcagggaggctgtcgtggcagtccatcaaggggacccacctcaccatcacccagggtgagtccagctgccctggcaccaaggaaccttcctggttcagccataggctcaggtgtgtggagggaatgacctgaggggctgtatgagggaacaacctcctggggctcccctatgcctgagttcctgcaactcagaagttgaggcccagagatccaggtagagggggctccagtcctgggactgccctgcaagtcatgtggcctgggacagggcttctccaagctctgtcccctcctgtgtagggcagggaggtcagaggggaccctgcagatccagtctcatgtctgggggtcaaggggtggcctcgagagggaccagtctctgtgtaggggaccgtcagccccctcaccccttgagcaagactgtggtccctgcaccaagggagcaggcctggggtgggaagaggccagctgggctgtggtggtgcctggggactgcatgggagcccctgccagggagggagagggacagaggacaagctgggggctctggtgcttgggctgggggctgagcgcctgtgacctccactggcttcctccttctcctctctgaggactgaatctggggtgcagcagagcacagactcaggcccgcctttcctctccctgaaagagcctgcgctggccttggacagagaaagggatgagaagtgaggctgagtgcggtggggtctgcagggatccaggtgggaggggcccagccagccaaggtgaggcccagcccctcagcaggaagatgggcactggggcccttgggcagggctgacttgacacttttgtgtgacttgagccactgtgcccagcctgaacaccctttcctggtaaaacactccacaaaccaggaagagaaggaatgtactgcaacaaaataaaggccagtcatgcaaggcccatggctgaaagtctttcagtcattttagatgaaagactgaaatctttgcctccaagatcaggaacaagagaaggatgcccgctctcactacttctattcaacacaggatttgaagtcaggccgggcacagtggctcacgcctgtaatcccagcacttttggaggctgaggcgggcagattacttgagcctatgagtgtgagaccaccctggccaacatggcaaaaccccatctctactaaaaaaaaaaaaaaaaaaggatttgaagtcctggccggagcaattaggcaagggataaaaaggcacctaaggcccttttgcaataagaagccagatggataaaggaagtgctggtcaccctggaggtgtactggtttggggaaggtccccggcccccacagccctctggggagcctcaccctggctctccccactcacctcagccccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccagggtgagtccagctgccctgacacctgccttgcccaccgcagtgagggttttggtgaccactgatgtcttcacatttaaacccagtggtctggattgagagctgttagcatttcaccttgctaccccttccatgtctgggcttctgagagcagcttgctcatcctgaatgtccccaatctagaaagcagcacaccatgcctttcatccagacgccccacacccccagaagagggtctgctcattcctcatctcttccagctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccata

SEQ ID NO: 355798 - DNA, 3822 bp, Homo sapiens
  misc_feature (33)..(33): n is a, c, g, or t
tgcagcggactcggcactgagagcacgagcatnggcacccagccaggcctcccaggctgctctccacgtcccttatgccactatcaacaccagctgctgcccagctactttggacacagctcacccccgacagggggccgtcctggtgggcatcactccccacccacaccgcacactggccccagggccctgctgcctgggcctccacatccatccctgcacatggcagctttgtctctgttgagaatggactctacgcttaggctgggcagaggcctccctgcactggtcctggcctcactcttttccctgacccttggggcccagggccatggagggacccttaggagttcaatgagagagaccatgaggccactgggctttccccttcccaggcctcctgggtgccacccccttacgttattcttgggcctctaataagtgtcccacaggtgcctggccaggcccacctgctgcagatgtggtctgtgtgtgtgcatgtgtgggtgtgtgtgggcacaggtgtgagtgtgtgagcaacagtaccccattccagtcgtttcctgctgtgactaagtcagcaacacagttcctctgacatgggccttggctgtgcttctttgggggtgaagagattggggaggaagtctccacccctgggaggcagaagccaggcatagcgcgctggctaggactccagtaccgtgaagggaggcagtgagagcagacatctgtgcctcattcctgatctcaaggggaaagcaagaacaagacctgtgaagggaaggagggtggatcggcctgactggccctgggaagcacagaggagcctactgggaccagggaagagactgacaagagaagggaggcctgtccctgcctgcttctgtctcaagaagattgttatcacttcctctggtgaaatcctgccttcctgtccccacggcccctcagctgatgccaccttactctggagaggatgggcagagcctcctatggagggagccctgtgggtcaccaaagctccagtgaccacccccgggcaaagacctgcagatcccctgttagagacgggcccaggactttgtgcggggtgcccactgttgctctgagccttcacttcctcagggaggcttcctcaggatctcgaacctgcggaaggaggaccagtctgtgtacttctgccaagtccagctggacatacagatcagggaggctgtcgtggcagtccatcaaggggacccacctcaccatcacccagggtgagtccagctgccctggcaccaaggaaccttcctggttcagccataggctcaggtgtgtggagggaatgacctgaggggctgtatgagggaacaacctcctggggctcccctatgcctgagttcctgcaactcagaagttgaggcccagagatccaggtagagggggctccagtcctgggactgccctgcaagtcatgtggcctgggacagggcttctccaagctctgtcccctcctgtgtagggcagggaggtcagaggggaccctgcagatccagtctcatgtctgggggtcaaggggtggcctcgagagggaccagtctctgtgtaggggaccgtcagccccctcaccccttgagcaagactgtggtccctgcaccaagggagcaggcctggggtgggaagaggccagctgggctgtggtggtgcctggggactgcatgggagcccctgccagggagggagagggacagaggacaagctgggggctctggtgcttgggctgggggctgagcgcctgtgacctccactggcttcctccttctcctctctgaggactgaatctggggtgcagcagagcacagactcaggcccgcctttcctctccctgaaagagcctgcgctggccttggacagagaaagggatgagaagtgaggctgagtgcggtggggtctgcagggatccaggtgggaggggcccagccagccaaggtgaggcccagcccctcagcaggaagatgggcactggggcccttgggcagggctgacttgacacttttgtgtgacttgagccactgtgcccagcctgaacaccctttcctggtaaaacactccacaaaccaggaagagaaggaatgtactgcaacaaaataaaggccagtcatgcaaggcccatggctgaaagtctttcagtcattttagatgaaagactgaaatctttgcctccaagatcaggaacaagagaaggatgcccgctctcactacttctattcaacacaggatttgaagtcaggccgggcacagtggctcacgcctgtaatcccagcacttttggaggctgaggcgggcagattacttgagcctatgagtgtgagaccaccctggccaacatggcaaaaccccatctctactaaaaaaaaaaaaaaaaaaggatttgaagtcctggccggagcaattaggcaagggataaaaaggcacctaaggcccttttgcaataagaagccagatggataaaggaagtgctggtcaccctggaggtgtactggtttggggaaggtccccggcccccacagccctctggggagcctcaccctggctctccccactcacctcagccccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccatacaccccttttctcctcgtccacattttccaatctgtatggtggctgtcttctatggcagaaggttttggggaataaatagcgtgaaatgctgctgacact

SEQ ID NO: 355799 - DNA, 2937 bp, Homo sapiens
  misc_feature (33)..(33): n is a, c, g, or t
tgcagcggactcggcactgagagcacgagcatnggcacccagccaggcctcccaggctgctctccacgtcccttatgccactatcaacaccagctgctgcccagctactttggacacagctcacccccgacagggggccgtcctggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagggaggctgtcgtggcagtccatcaaggggacccacctcaccatcacccagggtgagtccagctgccctggcaccaaggaaccttcctggttcagccataggctcaggtgtgtggagggaatgacctgaggggctgtatgagggaacaacctcctggggctcccctatgcctgagttcctgcaactcagaagttgaggcccagagatccaggtagagggggctccagtcctgggactgccctgcaagtcatgtggcctgggacagggcttctccaagctctgtcccctcctgtgtagggcagggaggtcagaggggaccctgcagatccagtctcatgtctgggggtcaaggggtggcctcgagagggaccagtctctgtgtaggggaccgtcagccccctcaccccttgagcaagactgtggtccctgcaccaagggagcaggcctggggtgggaagaggccagctgggctgtggtggtgcctggggactgcatgggagcccctgccagggagggagagggacagaggacaagctgggggctctggtgcttgggctgggggctgagcgcctgtgacctccactggcttcctccttctcctctctgaggactgaatctggggtgcagcagagcacagactcaggcccgcctttcctctccctgaaagagcctgcgctggccttggacagagaaagggatgagaagtgaggctgagtgcggtggggtctgcagggatccaggtgggaggggcccagccagccaaggtgaggcccagcccctcagcaggaagatgggcactggggcccttgggcagggctgacttgacacttttgtgtgacttgagccactgtgcccagcctgaacaccctttcctggtaaaacactccacaaaccaggaagagaaggaatgtactgcaacaaaataaaggccagtcatgcaaggcccatggctgaaagtctttcagtcattttagatgaaagactgaaatctttgcctccaagatcaggaacaagagaaggatgcccgctctcactacttctattcaacacaggatttgaagtcaggccgggcacagtggctcacgcctgtaatcccagcacttttggaggctgaggcgggcagattacttgagcctatgagtgtgagaccaccctggccaacatggcaaaaccccatctctactaaaaaaaaaaaaaaaaaaggatttgaagtcctggccggagcaattaggcaagggataaaaaggcacctaaggcccttttgcaataagaagccagatggataaaggaagtgctggtcaccctggaggtgtactggtttggggaaggtccccggcccccacagccctctggggagcctcaccctggctctccccactcacctcagccccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccatacaccccttttctcctcgtccacattttccaatctgtatggtggctgtcttctatggcagaaggttttggggaataaatagcgtgaaatgctgctgacact

SEQ ID NO: 355800 - DNA, 4181 bp, Homo sapiens
gggagtctggattataatcgcgacctaagatactggtcaaacatgccttatttcgagatcgatagggtctcaccatgttgcccaggctggtcttgaactcctggactcatcctaaagtgctggcctctcattccctgtctgtgcacacctcacggcaagggccagcctgtttcctcccggtcacctccaaatcttgctgcttttaattcaactcagaggtatgcacttgaggtaggagggcaggggaagtggggatggcaggacatggatggcccttgaggcattggctctgggtgtcatgggctgtgagagtcaagaagggcagtggcctgcctgacttgggttcgaaagggtcactctggccactgcggtgagaactgaaactagccaggccaattctccattgttcctgctcttccaggtaggagaatattagattaggtctggagtcagaaggtagcaggggctgggggttgcagggggatgttgagaagaagtggtcctttggtcagggtgggaagccaacaggatttcctggtgcattggaggtgaaagggaagaggcgctggtggttgtgctttgggcctgagcagccagaagccgttgccatcacctatgacaagggagacagcgcctggggcagagcccagtatggggtgcattcagggtagatcaggaggtatgagtgggcagtgggcgagccaggctgggggttgtgggggaggcctgggttgcaggtttaagcgtgggacccacgtcagattggtggtgggtcatgcatgctggggtggctctcaggtcctccctgctggcttcccactcccaggggctttctcctcccagattccttagctgggtgaggggcaggacagagccctttcctagggaagcccggcaccccctgctgtccagggaaggggagtccttctagcccctgacagcttctctgcccctcccctggcctccccaggcctagccagggttgagttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggtgaggggtccaggagggcagggaggggctcgggaactggccatccatctgattcttgcctctgtgcccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcatagcgcgctggctaggactccagtaccgtgaagggaggcagtgagagcagacatctgtgcctcattcctgatctcaaggggaaagcaagaacaagacctgtgaagggaaggagggtggatcggcctgactggccctgggaagcacagaggagcctactgggaccagggaagagactgacaagagaagggaggcctgtccctgcctgcttctgtctcaagaagattgttatcacttcctctggtgaaatcctgccttcctgtccccacggcccctcagctgatgccaccttactctggagaggatgggcagagcctcctatggagggagccctgtgggtcaccaaagctccagtgaccacccccgggcaaagacctgcagatcccctgttagagacgggcccaggactttgtgcggggtgcccactgttgctctgagccttcacttcctcagggaggcttcctcaggatctcgaacctgcggaaggaggaccagtctgtgtacttctgccaagtccagctggacatacagatcagggaggctgtcgtggcagtccatcaaggggacccacctcaccatcacccagggtgagtccagctgccctggcaccaaggaaccttcctggttcagccataggctcaggtgtgtggagggaatgacctgaggggctgtatgagggaacaacctcctggggctcccctatgcctgagttcctgcaactcagaagttgaggcccagagatccaggtagagggggctccagtcctgggactgccctgcaagtcatgtggcctgggacagggcttctccaagctctgtcccctcctgtgtagggcagggaggtcagaggggaccctgcagatccagtctcatgtctgggggtcaaggggtggcctcgagagggaccagtctctgtgtaggggaccgtcagccccctcaccccttgagcaagactgtggtccctgcaccaagggagcaggcctggggtgggaagaggccagctgggctgtggtggtgcctggggactgcatgggagcccctgccagggagggagagggacagaggacaagctgggggctctggtgcttgggctgggggctgagcgcctgtgacctccactggcttcctccttctcctctctgaggactgaaccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccata

SEQ ID NO: 355801 - DNA, 2906 bp, Homo sapiens
  misc_feature (33)..(33): n is a, c, g, or t
tgcagcggactcggcactgagagcacgagcatnggcacccagccaggcctcccaggctgctctccacgtcccttatgccactatcaacaccagctgctgcccagctactttggacacagctcacccccgacagggggccgtcctggtgggcatcactccccacccacaccgcacactggccccagggccctgctgcctgggcctccacatccatccctgcacatggcagctttgtctctgttgagaatggactctacgcttaggctgggcagaggcctccctgcactggtcctggcctcactcttttccctgacccttggggcccagggccatggagggacccttaggagttcaatgagagagaccatgaggccactgggctttccccttcccaggcctcctgggtgccacccccttacgttattcttgggcctctaataagtgtcccacaggtgcctggccaggcccacctgctgcagatgtggtctgtgtgtgtgcatgtgtgggtgtgtgtgggcacaggtgtgagtgtgtgagcaacagtaccccattccagtcgtttcctgctgtgactaagtcagcaacacagttcctctgacatgggccttggctgtgcttctttgggggtgaagagattggggaggaagtctccacccctgggaggcagaagccagtagagacgggtttcaccatgtttggctgggctggtctcgaactcctgacctcaggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagtctggggtgcagcagagcacagactcaggcccgcctttcctctccctgaaagagcctgcgctggccttggacagagaaagggatgagaagtgaggctgagtgcggtggggtctgcagggatccaggtgggaggggcccagccagccaaggtgaggcccagcccctcagcaggaagatgggcactggggcccttgggcagggctgacttgacacttttgtgtgacttgagccactgtgcccagcctgaacaccctttcctggtaaaacactccacaaaccaggaagagaaggaatgtactgcaacaaaataaaggccagtcatgcaaggcccatggctgaaagtctttcagtcattttagatgaaagactgaaatctttgcctccaagatcaggaacaagagaaggatgcccgctctcactacttctattcaacacaggatttgaagtcaggccgggcacagtggctcacgcctgtaatcccagcacttttggaggctgaggcgggcagattacttgagcctatgagtgtgagaccaccctggccaacatggcaaaaccccatctctactaaaaaaaaaaaaaaaaaaggatttgaagtcctggccggagcaattaggcaagggataaaaaggcacctaaggcccttttgcaataagaagccagatggataaaggaagtgctggtcaccctggaggtgtactggtttggggaaggtccccggcccccacagccctctggggagcctcaccctggctctccccactcacctcagccccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccatacaccccttttctcctcgtccacattttccaatctgtatggtggctgtcttctatggcagaaggttttggggaataaatagcgtgaaatgctgctgacact

SEQ ID NO: 355802 - DNA, 5089 bp, Homo sapiens
gggagtctggattataatcgcgacctaagatactggtcaaacatgccttatttcgagatcgatagggtctcaccatgttgcccaggctggtcttgaactcctggactcatcctaaagtgctggcctctcattccctgtctgtgcacacctcacggcaagggccagcctgtttcctcccggtcacctccaaatcttgctgcttttaattcaactcagaggtatgcacttgaggtaggagggcaggggaagtggggatggcaggacatggatggcccttgaggcattggctctgggtgtcatgggctgtgagagtcaagaagggcagtggcctgcctgacttgggttcgaaagggtcactctggccactgcggtgagaactgaaactagccaggccaattctccattgttcctgctcttccaggtaggagaatattagattaggtctggagtcagaaggtagcaggggctgggggttgcagggggatgttgagaagaagtggtcctttggtcagggtgggaagccaacaggatttcctggtgcattggaggtgaaagggaagaggcgctggtggttgtgctttgggcctgagcagccagaagccgttgccatcacctatgacaagggagacagcgcctggggcagagcccagtatggggtgcattcagggtagatcaggaggtatgagtgggcagtgggcgagccaggctgggggttgtgggggaggcctgggttgcaggtttaagcgtgggacccacgtcagattggtggtgggtcatgcatgctggggtggctctcaggtcctccctgctggcttcccactcccaggggctttctcctcccagattccttagctgggtgaggggcaggacagagccctttcctagggaagcccggcaccccctgctgtccagggaaggggagtccttctagcccctgacagcttctctgcccctcccctggcctccccaggcctagccagggttgagttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggtgaggggtccaggagggcagggaggggctcgggaactggccatccatctgattcttgcctctgtgcccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcatagcgcgctggctaggactccagtaccgtgaagggaggcagtgagagcagacatctgtgcctcattcctgatctcaaggggaaagcaagaacaagacctgtgaagggaaggagggtggatcggcctgactggccctgggaagcacagaggagcctactgggaccagggaagagactgacaagagaagggaggcctgtccctgcctgcttctgtctcaagaagattgttatcacttcctctggtgaaatcctgccttcctgtccccacggcccctcagctgatgccaccttactctggagaggatgggcagagcctcctatggagggagccctgtgggtcaccaaagctccagtgaccacccccgggcaaagacctgcagatcccctgttagagacgggcccaggactttgtgcggggtgcccactgttgctctgagccttcacttcctcagggaggcttcctcaggatctcgaacctgcggaaggaggaccagtctgtgtacttctgccaagtccagctggacatacagatcagggaggctgtcgtggcagtccatcaaggggacccacctcaccatcacccagggtgagtccagctgccctggcaccaaggaaccttcctggttcagccataggctcaggtgtgtggagggaatgacctgaggggctgtatgagggaacaacctcctggggctcccctatgcctgagttcctgcaactcagaagttgaggcccagagatccaggtagagggggctccagtcctgggactgccctgcaagtcatgtggcctgggacagggcttctccaagctctgtcccctcctgtgtagggcagggaggtcagaggggaccctgcagatccagtctcatgtctgggggtcaaggggtggcctcgagagggaccagtctctgtgtaggggaccgtcagccccctcaccccttgagcaagactgtggtccctgcaccaagggagcaggcctggggtgggaagaggccagctgggctgtggtggtgcctggggactgcatgggagcccctgccagggagggagagggacagaggacaagctgggggctctggtgcttgggctgggggctgagcgcctgtgacctccactggcttcctccttctcctctctgaggactgaatctggggtgcagcagagcacagactcaggcccgcctttcctctccctgaaagagcctgcgctggccttggacagagaaagggatgagaagtgaggctgagtgcggtggggtctgcagggatccaggtgggaggggcccagccagccaaggtgaggcccagcccctcagcaggaagatgggcactggggcccttgggcagggctgacttgacacttttgtgtgacttgagccactgtgcccagcctgaacaccctttcctggtaaaacactccacaaaccaggaagagaaggaatgtactgcaacaaaataaaggccagtcatgcaaggcccatggctgaaagtctttcagtcattttagatgaaagactgaaatctttgcctccaagatcaggaacaagagaaggatgcccgctctcactacttctattcaacacaggatttgaagtcaggccgggcacagtggctcacgcctgtaatcccagcacttttggaggctgaggcgggcagattacttgagcctatgagtgtgagaccaccctggccaacatggcaaaaccccatctctactaaaaaaaaaaaaaaaaaaggatttgaagtcctggccggagcaattaggcaagggataaaaaggcacctaaggcccttttgcaataagaagccagatggataaaggaagtgctggtcaccctggaggtgtactggtttggggaaggtccccggcccccacagccctctggggagcctcaccctggctctccccactcacctcagccccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtcagcagcggactaaagccacaaccccagccaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccatacaccccttttctcctcgtccacattttccaatctgtatggtggctgtcttctatggcagaaggttttggggaataaatagcgtgaaatgctgctgacact

SEQ ID NO: 355803 - DNA, 1618 bp, Homo sapiens
  misc_feature (33)..(33): n is a, c, g, or t
tgcagcggactcggcactgagagcacgagcatnggcacccagccaggcctcccaggctgctctccacgtcccttatgccactatcaacaccagctgctgcccagctactttggacacagctcacccccgacagggggccgtcctgtcgtttcctgctgtgactaagtcagcaacacagttcctctgacatgggccttggctgtgcttctttgggggtgaagagattggggaggaagtctccacccctgggaggcagaagccaggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagggaggctgtcgtggcagtccatcaaggggacccacctcaccatcacccaggccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccata

SEQ ID NO: 355804 - DNA, 5346 bp, Homo sapiens
gggagtctggattataatcgcgacctaagatactggtcaaacatgccttatttcgagatcgatagggtctcaccatgttgcccaggctggtcttgaactcctggactcatcctaaagtgctggcctctcattccctgtctgtgcacacctcacggcaagggccagcctgtttcctcccggtcacctccaaatcttgctgcttttaattcaactcagaggtatgcacttgaggtaggagggcaggggaagtggggatggcaggacatggatggcccttgaggcattggctctgggtgtcatgggctgtgagagtcaagaagggcagtggcctgcctgacttgggttcgaaagggtcactctggccactgcggtgagaactgaaactagccaggccaattctccattgttcctgctcttccaggtaggagaatattagattaggtctggagtcagaaggtagcaggggctgggggttgcagggggatgttgagaagaagtggtcctttggtcagggtgggaagccaacaggatttcctggtgcattggaggtgaaagggaagaggcgctggtggttgtgctttgggcctgagcagccagaagccgttgccatcacctatgacaagggagacagcgcctggggcagagcccagtatggggtgcattcagggtagatcaggaggtatgagtgggcagtgggcgagccaggctgggggttgtgggggaggcctgggttgcaggtttaagcgtgggacccacgtcagattggtggtgggtcatgcatgctggggtggctctcaggtcctccctgctggcttcccactcccaggggctttctcctcccagattccttagctgggtgaggggcaggacagagccctttcctagggaagcccggcaccccctgctgtccagggaaggggagtccttctagcccctgacagcttctctgcccctcccctggcctccccaggcctagccagggttgagttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggtgaggggtccaggagggcagggaggggctcgggaactggccatccatctgattcttgcctctgtgcccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcatagcgcgctggctaggactccagtaccgtgaagggaggcagtgagagcagacatctgtgcctcattcctgatctcaaggggaaagcaagaacaagacctgtgaagggaaggagggtggatcggcctgactggccctgggaagcacagaggagcctactgggaccagggaagagactgacaagagaagggaggcctgtccctgcctgcttctgtctcaagaagattgttatcacttcctctggtgaaatcctgccttcctgtccccacggcccctcagctgatgccaccttactctggagaggatgggcagagcctcctatggagggagccctgtgggtcaccaaagctccagtgaccacccccgggcaaagacctgcagatcccctgttagagacgggcccaggactttgtgcggggtgcccactgttgctctgagccttcacttcctcagggaggcttcctcaggatctcgaacctgcggaaggaggaccagtctgtgtacttctgccaagtccagctggacatacagatcagggaggctgtcgtggcagtccatcaaggggacccacctcaccatcacccagggtgagtccagctgccctggcaccaaggaaccttcctggttcagccataggctcaggtgtgtggagggaatgacctgaggggctgtatgagggaacaacctcctggggctcccctatgcctgagttcctgcaactcagaagttgaggcccagagatccaggtagagggggctccagtcctgggactgccctgcaagtcatgtggcctgggacagggcttctccaagctctgtcccctcctgtgtagggcagggaggtcagaggggaccctgcagatccagtctcatgtctgggggtcaaggggtggcctcgagagggaccagtctctgtgtaggggaccgtcagccccctcaccccttgagcaagactgtggtccctgcaccaagggagcaggcctggggtgggaagaggccagctgggctgtggtggtgcctggggactgcatgggagcccctgccagggagggagagggacagaggacaagctgggggctctggtgcttgggctgggggctgagcgcctgtgacctccactggcttcctccttctcctctctgaggactgaatctggggtgcagcagagcacagactcaggcccgcctttcctctccctgaaagagcctgcgctggccttggacagagaaagggatgagaagtgaggctgagtgcggtggggtctgcagggatccaggtgggaggggcccagccagccaaggtgaggcccagcccctcagcaggaagatgggcactggggcccttgggcagggctgacttgacacttttgtgtgacttgagccactgtgcccagcctgaacaccctttcctggtaaaacactccacaaaccaggaagagaaggaatgtactgcaacaaaataaaggccagtcatgcaaggcccatggctgaaagtctttcagtcattttagatgaaagactgaaatctttgcctccaagatcaggaacaagagaaggatgcccgctctcactacttctattcaacacaggatttgaagtcaggccgggcacagtggctcacgcctgtaatcccagcacttttggaggctgaggcgggcagattacttgagcctatgagtgtgagaccaccctggccaacatggcaaaaccccatctctactaaaaaaaaaaaaaaaaaaggatttgaagtcctggccggagcaattaggcaagggataaaaaggcacctaaggcccttttgcaataagaagccagatggataaaggaagtgctggtcaccctggaggtgtactggtttggggaaggtccccggcccccacagccctctggggagcctcaccctggctctccccactcacctcagccccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccagggtgagtccagctgccctgacacctgccttgcccaccgcagtgagggttttggtgaccactgatgtcttcacatttaaacccagtggtctggattgagagctgttagcatttcaccttgctaccccttccatgtctgggcttctgagagcagcttgctcatcctgaatgtccccaatctagaaagcagcacaccatgcctttcatccagacgccccacacccccagaagagggtctgctcattcctcatctcttccagctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtcagcagcggactaaagccacaaccccagccaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccatacaccccttttctcctcgtccacattttccaatctgtatggtggctgtcttctatggcagaaggttttggggaataaatagcgtgaaatgctgctgacact

SEQ ID NO: 355805 - DNA, 2586 bp, Homo sapiens
gggagtctggattataatcgcgacctaagatactggtcaaacatgccttatttcgagatcgatagggtctcaccatgttgcccaggctggtcttgaactcctggactcatcctaaagtgctggcctctcattccctgtctgtgcacacctcacggcaagggccagcctgtttcctcccggtcacctccaaatcttgctgcttttaattcaactcagaggtatgcacttgaggtaggagggcaggggaagtggggatggcaggacatggatggcccttgaggcattggctctgggtgtcatgggctgtgagagtcaagaagggcagtggcctgcctgacttgggttcgaaagggtcactctggccactgcggtgagaactgaaactagccaggccaattctccattgttcctgctcttccaggtaggagaatattagattaggtctggagtcagaaggtagcaggggctgggggttgcagggggatgttgagaagaagtggtcctttggtcagggtgggaagccaacaggatttcctggtgcattggaggtgaaagggaagaggcgctggtggttgtgctttgggcctgagcagccagaagccgttgccatcacctatgacaagggagacagcgcctggggcagagcccagtatggggtgcattcagggtagatcaggaggtatgagtgggcagtgggcgagccaggctgggggttgtgggggaggcctgggttgcaggtttaagcgtgggacccacgtcagattggtggtgggtcatgcatgctggggtggctctcaggtcctccctgctggcttcccactcccaggggctttctcctcccagattccttagctgggtgaggggcaggacagagccctttcctagggaagcccggcaccccctgctgtccagggaaggggagtccttctagcccctgacagcttctctgcccctcccctggcctccccaggcctagccagggttgagttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggtgaggggtccaggagggcagggaggggctcgggaactggccatccatctgattcttgcctctgtgcccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagggaggctgtcgtggcagtccatcaaggggacccacctcaccatcacccaggccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctgagggtcaggagagcggcttcctcaggatctcaaacctgcggaaggaggaccagtctgtgtatttctgccgagtcgagctggacacccggagatcagggaggcagcagttgcagtccatcaagggacaactaccataccagctgacaccacacactgaggcagagcacacatacgctaggtcaaagaagcctaatatgcagtgcatgctagtgtgtgctggtacgattgcggccccggggagagcgcacctcaaggagtgtcggaagctcacctgaggcgagcgggcacggcctacatagc

SEQ ID NO: 355806 - DNA, 2190 bp, Homo sapiens
gggagtctggattataatcgcgacctaagatactggtcaaacatgccttatttcgagatcgatagggtctcaccatgttgcccaggctggtcttgaactcctggactcatcctaaagtgctggcctctcattccctgtctgtgcacacctcacggcaagggccagcctgtttcctcccggtcacctccaaatcttgctgcttttaattcaactcagaggtatgcacttgaggtaggagggcaggggaagtggggatggcaggacatggatggcccttgaggcattggctctgggtgtcatgggctgtgagagtcaagaagggcagtggcctgcctgacttgggttcgaaagggtcactctggccactgcggtgagaactgaaactagccaggccaattctccattgttcctgctcttccaggtaggagaatattagattaggtctggagtcagaaggtagcaggggctgggggttgcagggggatgttgagaagaagtggtcctttggtcagggtgggaagccaacaggatttcctggtgcattggaggtgaaagggaagaggcgctggtggttgtgctttgggcctgagcagccagaagccgttgccatcacctatgacaagggagacagcgcctggggcagagcccagtatggggtgcattcagggtagatcaggaggtatgagtgggcagtgggcgagccaggctgggggttgtgggggaggcctgggttgcaggtttaagcgtgggacccacgtcagattggtggtgggtcatgcatgctggggtggctctcaggtcctccctgctggcttcccactcccaggggctttctcctcccagattccttagctgggtgaggggcaggacagagccctttcctagggaagcccggcaccccctgctgtccagggaaggggagtccttctagcccctgacagcttctctgcccctcccctggcctccccaggcctagccagggttgagttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggtgaggggtccaggagggcagggaggggctcgggaactggccatccatctgattcttgcctctgtgcccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagggaggctgtcgtggcagtccatcaaggggacccacctcaccatcacccaggccctcccctcctctgtgctgacagcacagaggaggcagaggagggaggagg

SEQ ID NO: 355807 - DNA, 546 bp, Homo sapiens
  misc_feature (33)..(33): n is a, c, g, or t
tgcagcggactcggcactgagagcacgagcatnggcacccagccaggcctcccaggctgctctccacgtcccttatgccactatcaacaccagctgctgcccagctactttggacacagctcacccccgacagggggccgtcctgtcgtttcctgctgtgactaagtcagcaacacagttcctctgacatgggccttggctgtgcttctttgggggtgaagagattggggaggaagtctccacccctgggaggcagaagccaggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagggaggctgtcgtggcagtccatcaaggggacccacctcaccatcacccaggccctcccctcctctgtgctgacagcacagaggaggcagaggagggaggagg

SEQ ID NO: 355808 - DNA, 914 bp, Homo sapiens
  misc_feature (33)..(33): n is a, c, g, or t
tgcagcggactcggcactgagagcacgagcatnggcacccagccaggcctcccaggctgctctccacgtcccttatgccactatcaacaccagctgctgcccagctactttggacacagctcacccccgacagggggccgtcctggtgggcatcactccccacccacaccgcacactggccccagggccctgctgcctgggcctccacatccatccctgcacatggcagctttgtctctgttgagaatggactctacgcttaggctgggcagaggcctccctgcactggtcctggcctcactcttttccctgacccttggggcccagggccatggagggacccttaggagttcaatgagagagaccatgaggccactgggctttccccttcccaggcctcctgggtgccacccccttacgttattcttgggcctctaataagtgtcccacaggtgcctggccaggcccacctgctgcagatgtggtctgtgtgtgtgcatgtgtgggtgtgtgtgggcacaggtgtgagtgtgtgagcaacagtaccccattccagtcgtttcctgctgtgactaagtcagcaacacagttcctctgacatgggccttggctgtgcttctttgggggtgaagagattggggaggaagtctccacccctgggaggcagaagccagtagagacgggtttcaccatgtttggctgggctggtctcgaactcctgacctcaggtgatccacccaccttggcctcccaaagtgctgagattacagacttgagccacggtgccccgcctgaataggagcttcttaatcaaaatttcagcatggctctgggtcaaaattgaccagctgatttaataagttgatgtaaaaattttacagtcagctacccctgggagggggagtctctcccta

SEQ ID NO: 355809 - DNA, 775 bp, Homo sapiens
  misc_feature (33)..(33): n is a, c, g, or t
tgcagcggactcggcactgagagcacgagcatnggcacccagccaggcctcccaggctgctctccacgtcccttatgccactatcaacaccagctgctgcccagctactttggacacagctcacccccgacagggggccgtcctggtgggcatcactccccacccacaccgcacactggccccagggccctgctgcctgggcctccacatccatccctgcacatggcagctttgtctctgttgagaatggactctacgcttaggctgggcagaggcctccctgcactggtcctggcctcactcttttccctgacccttggggcccagggccatggagggacccttaggagttcaatgagagagaccatgaggccactgggctttccccttcccaggcctcctgggtgccacccccttacgttattcttgggcctctaataagtgtcccacaggtgcctggccaggcccacctgctgcagatgtggtctgtgtgtgtgcatgtgtgggtgtgtgtgggcacaggtgtgagtgtgtgagcaacagtaccccattccagtcgtttcctgctgtgactaagtcagcaacacagttcctctgacatgggccttggctgtgcttctttgggggtgaagagattggggaggaagtctccacccctgggaggcagaagccaggtgagaaccagagtgggttggggcctccttgcagggctgggtttggcccagggagagggcagtgtcccagtcttagagatctgtcctggcttcttggggtg

SEQ ID NO: 355810 - DNA, 414 bp, Homo sapiens
ctgcatctaaaaacacttcccctcctgcaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccat

SEQ ID NO: 355811 - DNA, 4638 bp, Homo sapiens
gggagtctggattataatcgcgacctaagatactggtcaaacatgccttatttcgagatcgatagggtctcaccatgttgcccaggctggtcttgaactcctggactcatcctaaagtgctggcctctcattccctgtctgtgcacacctcacggcaagggccagcctgtttcctcccggtcacctccaaatcttgctgcttttaattcaactcagaggtatgcacttgaggtaggagggcaggggaagtggggatggcaggacatggatggcccttgaggcattggctctgggtgtcatgggctgtgagagtcaagaagggcagtggcctgcctgacttgggttcgaaagggtcactctggccactgcggtgagaactgaaactagccaggccaattctccattgttcctgctcttccaggtaggagaatattagattaggtctggagtcagaaggtagcaggggctgggggttgcagggggatgttgagaagaagtggtcctttggtcagggtgggaagccaacaggatttcctggtgcattggaggtgaaagggaagaggcgctggtggttgtgctttgggcctgagcagccagaagccgttgccatcacctatgacaagggagacagcgcctggggcagagcccagtatggggtgcattcagggtagatcaggaggtatgagtgggcagtgggcgagccaggctgggggttgtgggggaggcctgggttgcaggtttaagcgtgggacccacgtcagattggtggtgggtcatgcatgctggggtggctctcaggtcctccctgctggcttcccactcccaggggctttctcctcccagattccttagctgggtgaggggcaggacagagccctttcctagggaagcccggcaccccctgctgtccagggaaggggagtccttctagcccctgacagcttctctgcccctcccctggcctccccaggcctagccagggttgagttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggtgaggggtccaggagggcagggaggggctcgggaactggccatccatctgattcttgcctctgtgcccagggctctctgtcccgccgactcctgcccccattctgcgggcagacctggccgggatcttgggggtctcaggagtccttctctttgactgtggctacctccttcatctgctgtgccgacagaagcaccggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagggaggctgtcgtggcagtccatcaaggggacccacctcaccatcacccagggtgagtccagctgccctggcaccaaggaaccttcctggttcagccataggctcaggtgtgtggagggaatgacctgaggggctgtatgagggaacaacctcctggggctcccctatgcctgagttcctgcaactcagaagttgaggcccagagatccaggtagagggggctccagtcctgggactgccctgcaagtcatgtggcctgggacagggcttctccaagctctgtcccctcctgtgtagggcagggaggtcagaggggaccctgcagatccagtctcatgtctgggggtcaaggggtggcctcgagagggaccagtctctgtgtaggggaccgtcagccccctcaccccttgagcaagactgtggtccctgcaccaagggagcaggcctggggtgggaagaggccagctgggctgtggtggtgcctggggactgcatgggagcccctgccagggagggagagggacagaggacaagctgggggctctggtgcttgggctgggggctgagcgcctgtgacctccactggcttcctccttctcctctctgaggactgaatctggggtgcagcagagcacagactcaggcccgcctttcctctccctgaaagagcctgcgctggccttggacagagaaagggatgagaagtgaggctgagtgcggtggggtctgcagggatccaggtgggaggggcccagccagccaaggtgaggcccagcccctcagcaggaagatgggcactggggcccttgggcagggctgacttgacacttttgtgtgacttgagccactgtgcccagcctgaacaccctttcctggtaaaacactccacaaaccaggaagagaaggaatgtactgcaacaaaataaaggccagtcatgcaaggcccatggctgaaagtctttcagtcattttagatgaaagactgaaatctttgcctccaagatcaggaacaagagaaggatgcccgctctcactacttctattcaacacaggatttgaagtcaggccgggcacagtggctcacgcctgtaatcccagcacttttggaggctgaggcgggcagattacttgagcctatgagtgtgagaccaccctggccaacatggcaaaaccccatctctactaaaaaaaaaaaaaaaaaaggatttgaagtcctggccggagcaattaggcaagggataaaaaggcacctaaggcccttttgcaataagaagccagatggataaaggaagtgctggtcaccctggaggtgtactggtttggggaaggtccccggcccccacagccctctggggagcctcaccctggctctccccactcacctcagccccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccatacaccccttttctcctcgtccacattttccaatctgtatggtggctgtcttctatggcagaaggttttggggaataaatagcgtgaaatgctgctgacact

SEQ ID NO: 355812 - DNA, 5149 bp, Homo sapiens
  misc_feature (5132)..(5132): n is a, c, g, or t
gggagtctggattataatcgcgacctaagatactggtcaaacatgccttatttcgagatcgatagggtctcaccatgttgcccaggctggtcttgaactcctggactcatcctaaagtgctggcctctcattccctgtctgtgcacacctcacggcaagggccagcctgtttcctcccggtcacctccaaatcttgctgcttttaattcaactcagaggtatgcacttgaggtaggagggcaggggaagtggggatggcaggacatggatggcccttgaggcattggctctgggtgtcatgggctgtgagagtcaagaagggcagtggcctgcctgacttgggttcgaaagggtcactctggccactgcggtgagaactgaaactagccaggccaattctccattgttcctgctcttccaggtaggagaatattagattaggtctggagtcagaaggtagcaggggctgggggttgcagggggatgttgagaagaagtggtcctttggtcagggtgggaagccaacaggatttcctggtgcattggaggtgaaagggaagaggcgctggtggttgtgctttgggcctgagcagccagaagccgttgccatcacctatgacaagggagacagcgcctggggcagagcccagtatggggtgcattcagggtagatcaggaggtatgagtgggcagtgggcgagccaggctgggggttgtgggggaggcctgggttgcaggtttaagcgtgggacccacgtcagattggtggtgggtcatgcatgctggggtggctctcaggtcctccctgctggcttcccactcccaggggctttctcctcccagattccttagctgggtgaggggcaggacagagccctttcctagggaagcccggcaccccctgctgtccagggaaggggagtccttctagcccctgacagcttctctgcccctcccctggcctccccaggcctagccagggttgagttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggtgaggggtccaggagggcagggaggggctcgggaactggccatccatctgattcttgcctctgtgcccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcatagcgcgctggctaggactccagtaccgtgaagggaggcagtgagagcagacatctgtgcctcattcctgatctcaaggggaaagcaagaacaagacctgtgaagggaaggagggtggatcggcctgactggccctgggaagcacagaggagcctactgggaccagggaagagactgacaagagaagggaggcctgtccctgcctgcttctgtctcaagaagattgttatcacttcctctggtgaaatcctgccttcctgtccccacggcccctcagctgatgccaccttactctggagaggatgggcagagcctcctatggagggagccctgtgggtcaccaaagctccagtgaccacccccgggcaaagacctgcagatcccctgttagagacgggcccaggactttgtgcggggtgcccactgttgctctgagccttcacttcctcagggaggcttcctcaggatctcgaacctgcggaaggaggaccagtctgtgtacttctgccaagtccagctggacatacagatcagggaggctgtcgtggcagtccatcaaggggacccacctcaccatcacccagggtgagtccagctgccctggcaccaaggaaccttcctggttcagccataggctcaggtgtgtggagggaatgacctgaggggctgtatgagggaacaacctcctggggctcccctatgcctgagttcctgcaactcagaagttgaggcccagagatccaggtagagggggctccagtcctgggactgccctgcaagtcatgtggcctgggacagggcttctccaagctctgtcccctcctgtgtagggcagggaggtcagaggggaccctgcagatccagtctcatgtctgggggtcaaggggtggcctcgagagggaccagtctctgtgtaggggaccgtcagccccctcaccccttgagcaagactgtggtccctgcaccaagggagcaggcctggggtgggaagaggccagctgggctgtggtggtgcctggggactgcatgggagcccctgccagggagggagagggacagaggacaagctgggggctctggtgcttgggctgggggctgagcgcctgtgacctccactggcttcctccttctcctctctgaggactgaatctggggtgcagcagagcacagactcaggcccgcctttcctctccctgaaagagcctgcgctggccttggacagagaaagggatgagaagtgaggctgagtgcggtggggtctgcagggatccaggtgggaggggcccagccagccaaggtgaggcccagcccctcagcaggaagatgggcactggggcccttgggcagggctgacttgacacttttgtgtgacttgagccactgtgcccagcctgaacaccctttcctggtaaaacactccacaaaccaggaagagaaggaatgtactgcaacaaaataaaggccagtcatgcaaggcccatggctgaaagtctttcagtcattttagatgaaagactgaaatctttgcctccaagatcaggaacaagagaaggatgcccgctctcactacttctattcaacacaggatttgaagtcaggccgggcacagtggctcacgcctgtaatcccagcacttttggaggctgaggcgggcagattacttgagcctatgagtgtgagaccaccctggccaacatggcaaaaccccatctctactaaaaaaaaaaaaaaaaaaggatttgaagtcctggccggagcaattaggcaagggataaaaaggcacctaaggcccttttgcaataagaagccagatggataaaggaagtgctggtcaccctggaggtgtactggtttggggaaggtccccggcccccacagccctctggggagcctcaccctggctctccccactcacctcagccccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccatacaccccttttctcctcgtccacattttccaatctgtatggtggctgtcttctatggcagaaggttttggggaataaatagcgtgaaatgctgctgacacttataaaacatattcattaaacaaactttccttgaaggggggggccccggtcccccatttccgccctattatggggcnctttaacaatttaactg

SEQ ID NO: 355813 - DNA, 3262 bp, Homo sapiens
gggagtctggattataatcgcgacctaagatactggtcaaacatgccttatttcgagatcgatagggtctcaccatgttgcccaggctggtcttgaactcctggactcatcctaaagtgctggcctctcattccctgtctgtgcacacctcacggcaagggccagcctgtttcctcccggtcacctccaaatcttgctgcttttaattcaactcagaggtatgcacttgaggtaggagggcaggggaagtggggatggcaggacatggatggcccttgaggcattggctctgggtgtcatgggctgtgagagtcaagaagggcagtggcctgcctgacttgggttcgaaagggtcactctggccactgcggtgagaactgaaactagccaggccaattctccattgttcctgctcttccaggtaggagaatattagattaggtctggagtcagaaggtagcaggggctgggggttgcagggggatgttgagaagaagtggtcctttggtcagggtgggaagccaacaggatttcctggtgcattggaggtgaaagggaagaggcgctggtggttgtgctttgggcctgagcagccagaagccgttgccatcacctatgacaagggagacagcgcctggggcagagcccagtatggggtgcattcagggtagatcaggaggtatgagtgggcagtgggcgagccaggctgggggttgtgggggaggcctgggttgcaggtttaagcgtgggacccacgtcagattggtggtgggtcatgcatgctggggtggctctcaggtcctccctgctggcttcccactcccaggggctttctcctcccagattccttagctgggtgaggggcaggacagagccctttcctagggaagcccggcaccccctgctgtccagggaaggggagtccttctagcccctgacagcttctctgcccctcccctggcctccccaggcctagccagggttgagttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggtgaggggtccaggagggcagggaggggctcgggaactggccatccatctgattcttgcctctgtgcccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagggaggctgtcgtggcagtccatcaaggggacccacctcaccatcacccaggccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccata

SEQ ID NO: 355814 - DNA, 3618 bp, Homo sapiens
gggagtctggattataatcgcgacctaagatactggtcaaacatgccttatttcgagatcgatagggtctcaccatgttgcccaggctggtcttgaactcctggactcatcctaaagtgctggcctctcattccctgtctgtgcacacctcacggcaagggccagcctgtttcctcccggtcacctccaaatcttgctgcttttaattcaactcagaggtatgcacttgaggtaggagggcaggggaagtggggatggcaggacatggatggcccttgaggcattggctctgggtgtcatgggctgtgagagtcaagaagggcagtggcctgcctgacttgggttcgaaagggtcactctggccactgcggtgagaactgaaactagccaggccaattctccattgttcctgctcttccaggtaggagaatattagattaggtctggagtcagaaggtagcaggggctgggggttgcagggggatgttgagaagaagtggtcctttggtcagggtgggaagccaacaggatttcctggtgcattggaggtgaaagggaagaggcgctggtggttgtgctttgggcctgagcagccagaagccgttgccatcacctatgacaagggagacagcgcctggggcagagcccagtatggggtgcattcagggtagatcaggaggtatgagtgggcagtgggcgagccaggctgggggttgtgggggaggcctgggttgcaggtttaagcgtgggacccacgtcagattggtggtgggtcatgcatgctggggtggctctcaggtcctccctgctggcttcccactcccaggggctttctcctcccagattccttagctgggtgaggggcaggacagagccctttcctagggaagcccggcaccccctgctgtccagggaaggggagtccttctagcccctgacagcttctctgcccctcccctggcctccccaggcctagccagggttgagttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggtgaggggtccaggagggcagggaggggctcgggaactggccatccatctgattcttgcctctgtgcccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcatagcgcgctggctaggactccagtaccgtgaagggaggcagtgagagcagacatctgtgcctcattcctgatctcaaggggaaagcaagaacaagacctgtgaagggaaggagggtggatcggcctgactggccctgggaagcacagaggagcctactgggaccagggaagagactgacaagagaagggaggcctgtccctgcctgcttctgtctcaagaagattgttatcacttcctctggtgaaatcctgccttcctgtccccacggcccctcagctgatgccaccttactctggagaggatgggcagagcctcctatggagggagccctgtgggtcaccaaagctccagtgaccacccccgggcaaagacctgcagatcccctgttagagacgggcccaggactttgtgcggggtgcccactgttgctctgagccttcacttcctcagggaggcttcctcaggatctcgaacctgcggaaggaggaccagtctgtgtacttctgccaagtccagctggacatacagatcagggaggctgtcgtggcagtccatcaaggggacccacctcaccatcacccaggccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccata

SEQ ID NO: 355815 - DNA, 5702 bp, Homo sapiens
  misc_feature (4988)..(4989): n is a, c, g, or t
gggagtctggattataatcgcgacctaagatactggtcaaacatgccttatttcgagatcgatagggtctcaccatgttgcccaggctggtcttgaactcctggactcatcctaaagtgctggcctctcattccctgtctgtgcacacctcacggcaagggccagcctgtttcctcccggtcacctccaaatcttgctgcttttaattcaactcagaggtatgcacttgaggtaggagggcaggggaagtggggatggcaggacatggatggcccttgaggcattggctctgggtgtcatgggctgtgagagtcaagaagggcagtggcctgcctgacttgggttcgaaagggtcactctggccactgcggtgagaactgaaactagccaggccaattctccattgttcctgctcttccaggtaggagaatattagattaggtctggagtcagaaggtagcaggggctgggggttgcagggggatgttgagaagaagtggtcctttggtcagggtgggaagccaacaggatttcctggtgcattggaggtgaaagggaagaggcgctggtggttgtgctttgggcctgagcagccagaagccgttgccatcacctatgacaagggagacagcgcctggggcagagcccagtatggggtgcattcagggtagatcaggaggtatgagtgggcagtgggcgagccaggctgggggttgtgggggaggcctgggttgcaggtttaagcgtgggacccacgtcagattggtggtgggtcatgcatgctggggtggctctcaggtcctccctgctggcttcccactcccaggggctttctcctcccagattccttagctgggtgaggggcaggacagagccctttcctagggaagcccggcaccccctgctgtccagggaaggggagtccttctagcccctgacagcttctctgcccctcccctggcctccccaggcctagccagggttgagttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggtgaggggtccaggagggcagggaggggctcgggaactggccatccatctgattcttgcctctgtgcccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcatagcgcgctggctaggactccagtaccgtgaagggaggcagtgagagcagacatctgtgcctcattcctgatctcaaggggaaagcaagaacaagacctgtgaagggaaggagggtggatcggcctgactggccctgggaagcacagaggagcctactgggaccagggaagagactgacaagagaagggaggcctgtccctgcctgcttctgtctcaagaagattgttatcacttcctctggtgaaatcctgccttcctgtccccacggcccctcagctgatgccaccttactctggagaggatgggcagagcctcctatggagggagccctgtgggtcaccaaagctccagtgaccacccccgggcaaagacctgcagatcccctgttagagacgggcccaggactttgtgcggggtgcccactgttgctctgagccttcacttcctcagggaggcttcctcaggatctcgaacctgcggaaggaggaccagtctgtgtacttctgccaagtccagctggacatacagatcagggaggctgtcgtggcagtccatcaaggggacccacctcaccatcacccagggtgagtccagctgccctggcaccaaggaaccttcctggttcagccataggctcaggtgtgtggagggaatgacctgaggggctgtatgagggaacaacctcctggggctcccctatgcctgagttcctgcaactcagaagttgaggcccagagatccaggtagagggggctccagtcctgggactgccctgcaagtcatgtggcctgggacagggcttctccaagctctgtcccctcctgtgtagggcagggaggtcagaggggaccctgcagatccagtctcatgtctgggggtcaaggggtggcctcgagagggaccagtctctgtgtaggggaccgtcagccccctcaccccttgagcaagactgtggtccctgcaccaagggagcaggcctggggtgggaagaggccagctgggctgtggtggtgcctggggactgcatgggagcccctgccagggagggagagggacagaggacaagctgggggctctggtgcttgggctgggggctgagcgcctgtgacctccactggcttcctccttctcctctctgaggactgaatctggggtgcagcagagcacagactcaggcccgcctttcctctccctgaaagagcctgcgctggccttggacagagaaagggatgagaagtgaggctgagtgcggtggggtctgcagggatccaggtgggaggggcccagccagccaaggtgaggcccagcccctcagcaggaagatgggcactggggcccttgggcagggctgacttgacacttttgtgtgacttgagccactgtgcccagcctgaacaccctttcctggtaaaacactccacaaaccaggaagagaaggaatgtactgcaacaaaataaaggccagtcatgcaaggcccatggctgaaagtctttcagtcattttagatgaaagactgaaatctttgcctccaagatcaggaacaagagaaggatgcccgctctcactacttctattcaacacaggatttgaagtcaggccgggcacagtggctcacgcctgtaatcccagcacttttggaggctgaggcgggcagattacttgagcctatgagtgtgagaccaccctggccaacatggcaaaaccccatctctactaaaaaaaaaaaaaaaaaaggatttgaagtcctggccggagcaattaggcaagggataaaaaggcacctaaggcccttttgcaataagaagccagatggataaaggaagtgctggtcaccctggaggtgtactggtttggggaaggtccccggcccccacagccctctggggagcctcaccctggctctccccactcacctcagccccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccataaaaaaaaaaaaaaaaaaaaaaaaaaaaaaaaannaaaaaaaaaaaaaaaaaaaaaagtgggggggggggggggcaagaaaggatttaaaaaacaggtggggggggggggggacaaataggggatagagaaagagatgcacacacaagcgtgccccccaaaaaaaaaactgagggcactaacacaacacgagggttcggggtgcctccccacaaaaaaaaaaagccaccgcggagaggaaacgcagcaccgtgttcggacaacaaacccaccgcagagagggcgtacagaggaaggacaaaaccgggcgagccatcacccagaggacgggcacacaagagacagcacgaaaaacaagtaccccccggcgggggggaaaacaacagcagcagcagcaggaagacaaaaggacaaggcaaagaggggcagacacagaacgcgggcggaacagcagagggaaccggccaaggacaacaggagcacaggagagggagcgaaagcggagagagaggacggagcgttgcacacgcgaagcagacaggcggagacaggaaggaggcgcgcgagaagggacacagcaagacgacaggagcgaaaacagaagcgagagacggggagcgagggcaacggacggcagcgacgcagagacgcggcgcagcgccagggagagaggagaaccgcgagagcgagaagacgcggggagggggaggaagacgcacaagaagcgccaggagcagccacgaggcggg
